United States Patent 11,446,398 (REGULATED BIOCIRCUIT SYSTEMS) - sequence listing, part 81

SEQ ID NO: 184940 - DNA, 3818 bp, Homo sapiens
  Payload ID: 16413
  Gene Symbol: SNX13
  Gene Name: sorting nexin 13
  ENST ID: ENST00000409076
  CDS Start-End: 157-621
gaggggaggccagcgaagccgagtaaaaccgccgcccgggagaagactgaaggagcagttgccgccgttggcggcggcccgagcagttttcgctgctgctacggctgttgccatgaggcgaggctagggaggacctcacttccccggggtgtaataatgttaactgaggccagtctatccatatggggatggggaagccttggcattgtcctttttctgataacctttggaccctttgtaatattttatttgacattttatatcctctgctttgtgggtgggggtttagtggttactctcctgtttggaaaaacaaactcagagaagtacctagaacagtgtgaacactcatttcttcctccaacatcacctggggttcctaagtgcttagaagaaatgaaacgggaagccaggactattaagattgatagaagattgacgggtgccaatataattgatgaacctctccagcaagttatccagttttccttgagggattatgtccagtattggtattatacactaagcgatgatgaatcttttcttcttgaaattaggcagactcttcaaaacgcactcattcagtttgctactagatgctggggatacagcagtgaataaaacaaagtccctgctcagtggagtgaaatgaaatacctgtgacagtgttttgaaaattgtgaaggaatttagaaatttaagtttttatgccatccaacacccataattttactgatgaggaagctaaggtccagaaaggtcaaaagaaatagactggcaaccttattttactacacgcattgtagatgactttggcacacacttacgagtattcagaaaggctcaacagaaaataacagagaaagatgatcaagtgaaaggtacagcagaagatcttgtagataccttctttgaagttgaagttgaaatggagaaggaggtttgccgtgatctagtgtgcacttcccccaaagatgaagaaggattcctaagggatttgtgtgaggtcttactatatttattgctacctcctggagatttccagaacaagatcatgcgatactttgtcagggaaatccttgcacgaggaattcttcttccattaataaatcaactcagtgatcctgattatattaatcagtatgtcatatggatgatccgtgattctaactgcaactatgaggcctttatgaacattattaaattgagtgacaatattggagagctagaagcagtcagagataaggcagcagaagaattacagtatcttagatctctagatacagctggtgatgatatcaacactatcaaaaatcaaataaatagcttactattcgtaaagaaggtatgtgactcaagaatacagcgattgcagtcaggcaaagaaataaatactgtgaaacttgcagcaaactttgggaaactttgcacagtccccctggacagcattcttgtagacaatgttgcactacaattttttatggattacatgcagcaaactggaggtcaagcacatctattcttttggatgacagtggaaggataccgggttaccgcccaacagcagctagaagttttattaagtcgtcagagagatggaaaacatcaaaccaaccaaaccaaaggtcttttaagagcagctgctgttggaatttatgaacagtatttatcagaaaaggcatctccaagagttactgttgatgactatttagtagcaaaattagcagatactttgaatcatgaagatccaacccctgaaatctttgatgacattcaaagaaaggtatatgaattgatgctacgagatgaaagattttatccttccttcagacagaatgcactttatgtgcgcatgttagctgagcttgacatgttaaaagatcctagtttcagaggatccgatgatggggatggagaatcttttaatgggtctcctacaggaagcataaatttgtctttagatgacctttcaaatgtttcttctgatgactcagtacaacttcatgcctacatttcagacacaggcgtttgtaatgatcatggcaagacatatgcattatatgccatcactgtacaccggcgcaacctaaacagtgaggagatgtggaaaacctatcgtcgttatagtgacttccatgacttccacatgagaatcactgaacagtttgaaagtctctcaagcatattgaaacttcctggaaaaaagacttttaataatatggatagagattttttagaaaagagaaaaaaggatctaaatgcatatttgcagttactgttagctcctgaaatgatgaaggcatcccccgctttagctcactatgtgtatgatttccttgagaacaaagcctacagtaaaggaaaaggggattttgctcgcaagatggacacttttgtaaatccacttcgcaattcaatgaggaatgtttcaaatgcagttaaatcccttcctgatagcttggcagagggaatgactaaaatgtcagacaacatgggcaaaatgtcagaaagattaggtcaagacataaagcaatcattttttaaggtgcctcctttaattcctaagactgattcagaccctgaacatcgccgagtttcggctcaacttgacgataatgtggatgacaatattccacttagggtaatgctgcttctcatggatgaagtattcgacttaaaagaaagaaatcagtggttgcgaaggaatatcaaaaacctacttcaacagcttattagagctacatatggcgatactattaatagaaaaatagttgaccatgttgactggatgacttcacctgaacaagtagccgactcagtgaaacgtttcagagatgcattttggccaaatggcattttagcagaggctgttccatgcagagataaaagtattcgaatgagaacaagagtagcaggaaaaacgaaattacttgcaattatgccagatgagctgaagcacattattggggctgagacaacacggaaaggtattcttcgtgtttttgaaatgtttcagcacaaccaattaaataggagaatggtttatgtcttcttggaaggctttttagaaaccttatttccacagtataaattccgtgaacttttcaacaaactgcattcacggtcaaagcagatgcagaaatataaacagaaacttcaaactactcaagcgccttctttgcagaaaaggtgacactccactctatgaagctggtgttcattttgtccaggactaatggtatggacagatcttctggggcttaactcaaatactgttgtgtctgcaccagtcttttagtgtctcaaaatagattattaatacatccataagtctgtggttcttctcattctcatctataatccaccactaccaagagagatttctgtgtcttaaatgatttggtgcatattttgcaacattgagagaaaactgcccccatctcaagcaagaatggcgttggtttcttccatttcaaactaatcagcattctccagcaatgacaaagtgccagagtgtatatatgaaagctaaggaaagcacaaaacaatggttcagagataaattggctaatttgtttaacagttggagactgtgcaatgtacgacttggaggagtttgtttggcataatgattttgtaggtctgtcagcattttgatatattgtggattagccaggtgaatgatccttgaaacatctctttcaggtctggagaaagagacagaatgcccttaaagtgtgaaataaccttatacctgaattacagttttgtgatataaaataaagctgagtataaaataaaaccaatcaaacacagaa

SEQ ID NO: 184941 - DNA, 2018 bp, Homo sapiens
  Payload ID: 16413
  Gene Symbol: SNX13
  Gene Name: sorting nexin 13
  ENST ID: ENST00000444712
  CDS Start-End: 207-338
ggacgtcgctcttccaagatggcggcgcgtccgtcgcgagcgaccgggccgaggggaggccagcgaagccgagtaaaaccgccgcccgggagaagactgaaggagcagttgccgccgttggcggcggcccgagcagttttcgctgctgctacggctgttgccatgaggcgaggctagggaggacctcacttccccggggtgtaataatgttaactgaggccagtctatccatatggggatggggaagccttggcattgtcctttttctgataacctttggaccctttgtaatattttatttgacattttatatcctctgctttgtgggtggtgcttagaagaaatgaaacgggaagccaggactattaagattgatagaagattgacgggtgccaatataattgatgaacctctccagcaagttatccagttttccttgagggattatgtccagtattggtattatacactaagcgatgatgaatcttttcttcttgaaattaggcagactcttcaaaacgcactcattcagtttgctactaggtcaaaagaaatagactggcaaccttattttactacacgcattgtagatgactttggcacacacttacgagtattcagaaaggctcaacagaaaataacagagaaagatgatcaagtgaaaggtacagcagaagatcttgtagataccttctttgaagttgaagttgaaatggagaaggaggtttgccgtgatctagtgtgcacttcccccaaagatgaagaaggattcctaagggatttgtgtgaggtcttactatatttattgctacctcctggagatttccagaacaagatcatgcgatactttgtcagggaaatccttgcacgaggaattcttcttccattaataaatcaactcagtgatcctgattatattaatcagtatgtcatatggatgatccgtgattctaactgcaactatgaggcctttatgaacattattaaattgagtgacaatattggagagctagaagcagtcagagataaggcagcagaagaattacagtatcttagatctctagatacagctggtgatgatatcaacactatcaaaaatcaaataaatagcttactattcgtaaagaaggtatgtgactcaagaatacagcgattgcagtcaggcaaagaaataaatactgtgaaacttgcagcaaactttgggaaactttgcacagtccccctggacagcattcttgtagacaatgttgcactacaattttttatggattacatgcagcaaactggaggtcaagcacatctattcttttggatgacagtggaaggataccgggttaccgcccaacagcagctagaagttttattaagtcgtcagagagatggaaaacatcaaaccaaccaaaccaaaggtcttttaagagcagctgctgttggaatttatgaacagtatttatcagaaaaggcatctccaagagttactgttgatgactatttagtagcaaaattagcagatactttgaatcatgaagatccaacccctgaaatctttgatgacattcaaagaaaggtatatgaattgatgctacgagatgaaagattttatccttccttcagacagaatgcactttatgtgcgcatgttagctgagcttgacatgttaaaagatcctagtttcagaggatccgatgatggggatggagaatcttttaatgggtctcctacaggaagcataaatttgtctttagatgacctttcaaatgtttcttctgatgactcagtacaacttcatgcctacatttcagacacaggcgtttgtaatgatcatggcaagacatatgcattatatgccatcactgtacaccggcgcaacctaaacagtgaggagatgtggaaaacctatcgtcgttatagtgacttccatgacttccacatgagaatcactgaacagtttgaaagtctctcaagcatattgaaacttcctggaaaaaagacttttaataatatggatagagattttt

SEQ ID NO: 184942 - DNA, 6357 bp, Homo sapiens
  Payload ID: 16413
  Gene Symbol: SNX13
  Gene Name: sorting nexin 13
  Uniprot ID: Q9Y5W8
  ENST ID: ENST00000428135
  CDS Start-End: 200-3073
gctcttccaagatggcggcgcgtccgtcgcgagcgaccgggccgaggggaggccagcgaagccgagtaaaaccgccgcccgggagaagactgaaggagcagttgccgccgttggcggcggcccgagcagttttcgctgctgctacggctgttgccatgaggcgaggctagggaggacctcacttccccggggtgtaataatgttaactgaggccagtctatccatatggggatggggaagccttggcattgtcctttttctgataacctttggaccctttgtaatattttatttgacattttatatcctctgctttgtgggtgggggtttagtggttactctcctgtttggaaaaacaaactcagagaagtacctagaacagtgtgaacactcatttcttcctccaacatcacctggggttcctaagtgcttagaagaaatgaaacgggaagccaggactattaagattgatagaagattgacgggtgccaatataattgatgaacctctccagcaagttatccagttttccttgagggattatgtccagtattggtattatacactaagcgatgatgaatcttttcttcttgaaattaggcagactcttcaaaacgcactcattcagtttgctactaggtcaaaagaaatagactggcaaccttattttactacacgcattgtagatgactttggcacacacttacgagtattcagaaaggctcaacagaaaataacagagaaagatgatcaagtgaaaggtacagcagaagatcttgtagataccttctttgaagttgaagttgaaatggagaaggaggtttgccgtgatctagtgtgcacttcccccaaagatgaagaaggattcctaagggatttgtgtgaggtcttactatatttattgctacctcctggagatttccagaacaagatcatgcgatactttgtcagggaaatccttgcacgaggaattcttcttccattaataaatcaactcagtgatcctgattatattaatcagtatgtcatatggatgatccgtgattctaactgcaactatgaggcctttatgaacattattaaattgagtgacaatattggagagctagaagcagtcagagataaggcagcagaagaattacagtatcttagatctctagatacagctggtgatgatatcaacactatcaaaaatcaaataaatagcttactattcgtaaagaaggtatgtgactcaagaatacagcgattgcagtcaggcaaagaaataaatactgtgaaacttgcagcaaactttgggaaactttgcacagtccccctggacagcattcttgtagacaatgttgcactacaattttttatggattacatgcagcaaactggaggtcaagcacatctattcttttggatgacagtggaaggataccgggttaccgcccaacagcagctagaagttttattaagtcgtcagagagatggaaaacatcaaaccaaccaaaccaaaggtcttttaagagcagctgctgttggaatttatgaacagtatttatcagaaaaggcatctccaagagttactgttgatgactatttagtagcaaaattagcagatactttgaatcatgaagatccaacccctgaaatctttgatgacattcaaagaaaggtatatgaattgatgctacgagatgaaagattttatccttccttcagacagaatgcactttatgtgcgcatgttagctgagcttgacatgttaaaagatcctagtttcagaggatccgatgatggggatggagaatcttttaatgggtctcctacaggaagcataaatttgtctttagatgacctttcaaatgtttcttctgatgactcagtacaacttcatgcctacatttcagacacaggcgtttgtaatgatcatggcaagacatatgcattatatgccatcactgtacaccggcgcaacctaaacagtgaggagatgtggaaaacctatcgtcgttatagtgacttccatgacttccacatgagaatcactgaacagtttgaaagtctctcaagcatattgaaacttcctggaaaaaagacttttaataatatggatagagattttttagaaaagagaaaaaaggatctaaatgcatatttgcagttactgttagctcctgaaatgatgaaggcatcccccgctttagctcactatgtgtatgatttccttgagaacaaagcctacagtaaaggaaaaggggattttgctcgcaagatggacacttttgtaaatccacttcgcaattcaatgaggaatgtttcaaatgcagttaaatcccttcctgatagcttggcagagggaatgactaaaatgtcagacaacatgggcaaaatgtcagaaagattaggtcaagacataaagcaatcattttttaaggtgcctcctttaattcctaagactgattcagaccctgaacatcgccgagtttcggctcaacttgacgataatgtggatgacaatattccacttagggtaatgctgcttctcatggatgaagtattcgacttaaaagaaagaaatcagtggttgcgaaggaatatcaaaaacctacttcaacagcttattagagctacatatggcgatactattaatagaaaaatagttgaccatgttgactggatgacttcacctgaacaagtagccgactcagtgaaacgtttcagagatgcattttggccaaatggcattttagcagaggctgttccatgcagagataaaagtattcgaatgagaacaagagtagcaggaaaaacgaaattacttgcaattatgccagatgagctgaagcacattattggggctgagacaacacggaaaggtattcttcgtgtttttgaaatgtttcagcacaaccaattaaataggagaatggtttatgtcttcttggaaggctttttagaaaccttatttccacagtataaattccgtgaacttttcaacaaactgcattcacggtcaaagcagatgcagaaatataaacagaaacttcaaactactcaagcgccttctttgcagaaaaggtgacactccactctatgaagctggtgttcattttgtccaggactaatggtatggacagatcttctggggcttaactcaaatactgttgtgtctgcaccagtcttttagtgtctcaaaatagattattaatacatccataagtctgtggttcttctcattctcatctataatccaccactaccaagagagatttctgtgtcttaaatgatttggtgcatattttgcaacattgagagaaaactgcccccatctcaagcaagaatggcgttggtttcttccatttcaaactaatcagcattctccagcaatgacaaagtgccagagtgtatatatgaaagctaaggaaagcacaaaacaatggttcagagataaattggctaatttgtttaacagttggagactgtgcaatgtacgacttggaggagtttgtttggcataatgattttgtaggtctgtcagcattttgatatattgtggattagccaggtgaatgatccttgaaacatctctttcaggtctggagaaagagacagaatgcccttaaagtgtgaaataaccttatacctgaattacagttttgtgatataaaataaagctgagtataaaataaaaccaatcaaacacagaatttgattggatttgttattcattggtatacaacaatttttattcttatgtgtgctttaagggctgtgttttgctcttagggtactcaattttatgtttccttttggcattctttgtgcaaaaagaagcatgtggtggctctcatttaaatttcaaaattattagttttatctttaacagattactgattatacagaagatataatttattggaagaactgccaaatacattttgtccttctaaaaatatggaaatttaaatagtagtctggaaagttaccatatgataatttttaattgtgtgatctagacatgccttaggtaactgcagaaatagcaaattaaatgattaatgagcttattagtcatagtaaacatacagattcctaattctatgacagtgtacatatatgaaaataaatgatgaaaaaagaactataatatttttaaaaatatgcttttatttatatttcacataatgtaaagttctacaaaataaagctagtaggcaagacccctcagtgtatacctttaaacccataaattaattttatatcaataaaataaaatactttctctagttttggagcttctgtatttcctatagttttctgactgtccattttatccatcttagaagtattcacatcccttctatgcaggatttctgcatagttttaaatactttcattgcctaagggtttgggtgtgtcagctttttttgttttaaaaatatttaacactaaaaccttaaaataatgaagctacttatcagaccactgagccaagatcctggtattaaaagaaagtctgggtgcttaagataaagggacagagtattggtatcccagttatttgggagctttaagattggaacaagatatcactgtcttgttttcacttagatcctacttacaaagtgagggttattaacagaataaagccttcctttaaagctttataataatcatatttattaataatgctgttgtgcatacttatagtatgcatatattcagcatatgttgcatgtcttcagaattacataaaatgaaatccctttcattgcaacttgcaagtgagaaaagatccttagtggctctggtggaagaaatagtatttcttcttctcagggtgtctccctgccttggcccctccctgagccccaggctttaaaagtgaaaatgtttgaaacatgaaacatgtctgtaggaagcatcagcatggccataagtgcagtgattttcatatatgcctctgcccatttcaaatatatttttgacatgaataaatctaacagtatacagaataattcatgtaagaccctaacgtgtacatgtgaaaaagcatttctatataatgtgaggagcactggccatcaattagggaaataaaggtcatgtaatattgcaaattttcaaaatagagccctgcaagataactgcaatcataccaaaaactatttgagtaaatggatttttaaagtaatttttgtttagaagagtttatatttcagaagcagaaaatgtcaaatgatagtctttgtaaatggtggtgcaccttctctatgcacatctgtcttttacatcagaaagagctgtggtcatgctaaaattagagataactttttgaatgacttggtcaagctgtgtgtaaaatatttaaccataagtcaagtacagtgtactatgtttaataaagttacatttaatgcatttattgcatatatgaatatatacatgaagaggctttatgtcttctggtatttgattttgaatgttttttaagtcagtggtgcctttaggcaagaactttcgaaattaatcattctttgtgttttctgatttttcaggtaacatgtacactatttagaaaccatcatagtttattcaccttaaaaaattgattgtattatttaaatatatcacttagatgggcatttcctataattaggatattccaaatagttgctgaaatcaattgtgccattgaccaatggatgcacttggttagccttaatttttttaaaaaaaaaaaaaacaaaaactttcttgaatatttcagtttgttcattttaagtttgtgctgctggtatttgggaagaaaaatcaatcagttaagtgctaccagaaagtgtaccaatttttataaaaattaagaatgatataaatttcacaatctaaaattttaattttgtgcaatattttcatttaatgcatgtgtatttgagtaattgtaagataaatgaatttttaattttttgagatgtagcttaaactgtcttcttaatccaacaacttacattccgttgttgctgcatccttttatttaaggacttgttttaaaagtctttttgtcactccttggaaaattcttttattagtagtaaattttgcttttaggagcatggctcctgtattacaagggaaaaaatatgaagagcacattttaggattataattgttaaaagataatgtgtgcatatcattgtacagtaagtgtcaactgtgtgcctaactgttctatcaatactttctttctttaacaaagaagaaacaacaatcagaatgtcagttatttttattcaactaaaaggattaaaaaatttatttggtttgtgttctgtccattagaaaatactaataaagtattaacaaaca

SEQ ID NO: 184943 - DNA, 6817 bp, Homo sapiens
  Payload ID: 16413
  Gene Symbol: SNX13
  Gene Name: sorting nexin 13
  ENST ID: ENST00000611725
  CDS Start-End: 174-2840
tcgcgagcgaccgggccgaggggaggccagcgaagccgagtaaaaccgccgcccgggagaagactgaaggagcagttgccgccgttggcggcggcccgagcagttttcgctgctgctacggctgttgccatgaggcgaggctagggaggacctcacttccccggggtgtaataatgttaactgaggccagtctatccatatggggatggggaagccttggcattgtcctttttctgataacctttggaccctttgtaatattttatttgacattttatatcctctgctttgtgggtgggggtttagtggttactctcctgtttggaaaaacaaactcagagaagtacctagaacagtgtgaacactcatttcttcctccaacatcacctggggttcctaagtgcttagaagaaatgaaacgggaagccaggactattaagattgatagaagattgacgggtgccaatataattgatgaacctctccagcaagttatccagttttccttgagggattatgtccagtattggtattatacactaagcgatgatgaatcttttcttcttgaaattaggcagactcttcaaaacgcactcattcagtttgctactaggtcaaaagaaatagactggcaaccttattttactacacgcattgtagatgactttggcacacacttacgagtattcagaaaggctcaacagaaaataacagagaaagatgatcaagtgaaaggtacagcagaagatcttgtagataccttctttgaagttgaagttgaaatggagaaggaggtttgccgtgatctagtgtgcacttcccccaaagatgaagaaggattcctaagggatttgtgtgaggtcttactatatttattgctacctcctggagatttccagaacaagatcatgcgatactttgtcagggaaatccttgcacgaggaattcttcttccattaataaatcaactcagtgatcctgattatattaatcagtatgtcatatggatgatccgtgattctaactgcaactatgaggcctttatgaacattattaaattgagtgacaatattggagagctagaagcagtcagagataaggcagcagaagaattacagtatcttagatctctagatacagctggtgatgatatcaacactatcaaaaatcaaataaatagcttactattcgtaaagaaggtatgtgactcaagaatacagcgattgcagtcaggcaaagaaataaatactgtgaaacttgcagcaaactttgggaaactttgcacagtccccctggacagcattcttgtagacaatgttgcactacaattttttatggattacatgcagcaaactggaggtcaagcacatctattcttttggatgacagtggaaggataccgggttaccgcccaacagcagctagaagttttattaagtcgtcagagagatggaaaacatcaaaccaaccaaaccaaaggtcttttaagagcagctgctgttggaatttatgaacagtatttatcagaaaaggcatctccaagagttactgttgatgactatttagtagcaaaattagcagatactttgaatcatgaagatccaacccctgaaatctttgatgacattcaaagaaaggtatatgaattgatgctacgagatgaaagattttatccttccttcagacagaatgcactttatgtgcgcatgttagctgagcttgacatgttaaaagatcctagtttcagaggatccgatgatggggatggagaatcttttaatgggtctcctacaggaagcataaatttgtctttagatgacctttcaaatgtttcttctgatgactcagtacaacttcatgcctacatttcagacacagtatatgctgactatgacccatatgctgtggcaggcgtttgtaatgatcatggcaagacatatgcattatatgccatcactgtacaccggcgcaacctaaacagtgaggagatgtggaaaacctatcgtcgttatagtgacttccatgacttccacatgagaatcactgaacagtttgaaagtctctcaagcatattgaaacttcctggaaaaaagacttttaataatatggatagagattttttagaaaagagaaaaaaggatctaaatgcatatttgcagttactgttagctcctgaaatgatgaaggcatcccccgctttagctcactatgtgtatgatttccttgagaacaaagcctacagtaaaggaaaaggggattttgctcgcaagatggacacttttgtaaatccacttcgcaattcaatgaggaatgtttcaaatgcagttaaatcccttcctgatagcttggcagagggaatgactaaaatgtcagacaacatgggcaaaatgtcagaaagattaggtcaagacataaagcaatcattttttaaggtgcctcctttaattcctaagactgattcagaccctgaacatcgccgagtttcggctcaacttgacgataatgtggatgacaatattccacttagggtaatgctgcttctcatggatgaagtattcgacttaaaagaaagaaatcagtggttgcgaaggaatatcaaaaacctacttcaacagcttattagagctacatatggcgatactattaatagaaaaatagttgaccatgttgactggatgacttcacctgaacaagtagccgactcagtgaaacgtttcagagatgcattttggccaaatggcattttagcagaggctgttccatgcagagataaaagtattcgaatgagaacaagagtagcaggaaaaacgaaattacttgcaattatgccaggtgagtgagcatgtatagttaaaaatctttataatttgtcattcttctgagtttttagcattcatcatgccagtgtaactgccttttgattataacaactaccttttgatggcttaatacatatcaggcactgtactaggcatttctcatatgttcttaatcagtcctcatgacagtactgtaaagctaaggactgttaacatcaccgctttatatgtgaggaaacggaagctcagagaggttaaataacctatccaaggtttatagctactaagcaacagttggtattctgacttggctttaagtgatgtgaaagcttatgcttttagccacttcgctctgctgccttgaaacatattgggagttaagttaaataaataaaatacatgacaggtgaaagggctaataaaatataaagtatgaatttttcaggaagaatatttgttgtacttaggaaaacaagttatttcaaaaactccatttacatagaaagaactgattggctgattattaatctttattacttaaaatacaatcccaaacaaagtatacttagtagcattttgttggtctgattttggttgcttcattagggtatagctatctcactaccttagatttactttttctcgtttttcttctttcaatcagagaagttatataatgtaaaaagcaatttaatgcggctgggaggtggtgatggttgttttgccccttgttaatgagtatctttgaaaatgcctgcatgtcttttctctgtattttaattctggatgtagagaatgaacagacatatttgtacattctttaatatcacacaataccaatttttttctctaattttgttttcttacctgtattttctctataaattttaatgaccagccttctcttctgtcaattaaattaaaaatttgccacaattttaattcttacctatataccgtttcatttgctgataaaaaagcaaattatagaaatgacattttagaaaaataagaaacaattgcttaggatattatttaatatactattatagtaaacctgattgtgctatatggactgactcagttatctagctggaagaaatctttattcactaaatatttattgaaagttattatgtgccaggtgctgttctttgcacttatgtttgccttcttggagcttactttccagtagaaatagagagactcaaaaacacacagaacaaataaatggaacgtagtttgttagataagtggtaagtactaaagagaaagatactgcaggaaaatggaatagatagtgtcagatgagttgcagttttagatggggtggccagggcaggcctcactgagatgatgatggtggtgtgaagatctgaaggaagtgagggtaaatatgaaagcatataaatttatatatacataatccttgcctattttttagtaaattctcaaaatttttgctttaaattatatcttacccctagttagataaagactttttggaaattgcatgtttctttccaaagcagcaaaataatatctatattatcagtattatgaataattatttgtaattatgaataagaatatgaataattaataatcatacatgttggtctcataacttggtgttatttatgattaaacaccaaatttgctcactcttagtcacagcaccatcggttttctattttctttgctttcttcactttgaatttaaataaaattcaacccaacttgtactatccctatttcttgagcatgctttgttattctagttactgcttatttgctcattcatgttcttttcaccaaggctaatccttcatctcattgcacctatcaaaatcctgcccaagtagaaagtctcctttacctgccacttccttaaagggaacttttctttgttatcgcatctgaaagtctccccactaccaatattcttatacttttagcatttttatggtatagttactatgccaggggtttttgtagatcagggattaatttttttttttcctgtgttccaatgaaactttattcaccatcatggattagtttgtttccttacagcatttgtcactattcattaggcctactaagaatatttgtataatattacaaagtttacagatcactttttacattatttcattaaagacttataaatccttataaggatgttattataaatcctccttttcagatgagaaaagagagtcagggtggtgggtaagtatcacatgggtattaagggacatgtttgtaatcatagtttgggatctttgagactgttttttattttttatctcttacacctgtgctatattgtctcccagtagcttttgcattaagtgcgtaaatagatgcatgcatgcaaagatgcatattaagtttcagctatagtacatagctgaaatgcattaactggttacctactgttcatcagttactctgctgtgtaccttaatttaagaacatttaagagtttaggccttgtgtttcctttgaataattatgtgtgttttcctccacttcatttagatgagctgaagcacattattggggctgagacaacacggaaaggtattcttcgtgtttttgaaatgtttcagcacaaccaattaaataggagaatggtttatgtcttcttggaaggctttttagaaaccttatttccacagtataaattccgtgaacttttcaacaaactgcattcacggtcaaagcagatgcagaaatataaacagaaacttcaaactactcaagcgccttctttgcagaaaaggtgacactccactctatgaagctggtgttcattttgtccaggactaatggtatggacagatcttctggggcttaactcaaatactgttgtgtctgcaccagtcttttagtgtctcaaaatagattattaatacatccataagtctgtggttcttctcattctcatctataatccaccactaccaagagagatttctgtgtcttaaatgatttggtgcatattttgcaacattgagagaaaactgcccccatctcaagcaagaatggcgttggtttcttccatttcaaactaatcagcattctccagcaatgacaaagtgccagagtgtatatatgaaagctaaggaaagcacaaaacaatggttcagagataaattggctaatttgtttaacagttggagactgtgcaatgtacgacttggaggagtttgtttggcataatgattttgtaggtctgtcagcattttgatatattgtggattagccaggtgaatgatccttgaaacatctctttcaggtctggagaaagagacagaatgcccttaaagtgtgaaataaccttatacctgaattacagttttgtgatataaaataaagctgagtataaaataaaaccaatcaaacacagaatttgattggatttgttattcattggtatacaacaatttttattcttatgtgtgctttaagggctgtgttttgctcttagggtactcaattttatgtttccttttggcattctttgtgcaaaaagaagcatgtggtggctctcatttaaatttcaaaattattagttttatctttaacagattactgattatacagaagatataatttattggaagaactgccaaatacattttgtccttctaaaaatatggaaatttaaatagtagtctggaaagttaccatatgataatttttaattgtgtgatctagacatgccttaggtaactgcagaaatagcaaattaaatgattaatgagcttattagtcatagtaaacatacagattcctaattctatgacagtgtacatatatgaaaataaatgatgaaaaaagaactataatatttttaaaaatatgcttttatttatatttcacataatgtaaagttctacaaaataaagctagtaggcaagacccctcagtgtatacctttaaacccataaattaattttatatcaataaaataaaatactttctct

SEQ ID NO: 184944 - DNA, 3348 bp, Homo sapiens
  Payload ID: 16414
  Gene Symbol: SNX14
  Gene Name: sorting nexin 14
  Uniprot ID: Q9Y5W7
  ENST ID: ENST00000346348
  CDS Start-End: 196-2877
ccgcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacaggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtgattgagtctcatagtctttcatttgctagctgtgatccaaattttattagaacataagtcacttgttattgccatttttaaaagagaaaattcataatgatgttatggcaaacagataagactgataaacttcgtattgtatagctttgaaaataattatgcctagtatggagaaacaggaataagatctgattttcttagagttaatatattttagtagattggttttccttttttttattttgtacatagttaactgtgtatctataaataaagcatcctatatgagtttttaataataaa

SEQ ID NO: 184945 - DNA, 3486 bp, Homo sapiens
  Payload ID: 16414
  Gene Symbol: SNX14
  Gene Name: sorting nexin 14
  Uniprot ID: Q9Y5W7
  ENST ID: ENST00000314673
  CDS Start-End: 178-3018
ggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtgattgagtctcatagtctttcatttgctagctgtgatccaaattttattagaacataagtcacttgttattgccatttttaaaagagaaaattcataatgatgttatggcaaacagataagactgataaacttcgtattgtatagctttgaaaataattatgcctagtatggagaaacaggaataagatctgattttcttagagttaatatattttagtagattggttttccttttttttattttgtacatagttaactgtgtatctataaataaagcatcctatatgagtttttaataat

SEQ ID NO: 184946 - DNA, 3111 bp, Homo sapiens
  Payload ID: 16414
  Gene Symbol: SNX14
  Gene Name: sorting nexin 14
  Uniprot ID: Q9Y5W7
  ENST ID: ENST00000369627
  CDS Start-End: 133-2946
gcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacaggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaa

SEQ ID NO: 184947 - DNA, 2578 bp, Homo sapiens
  Payload ID: 16414
  Gene Symbol: SNX14
  Gene Name: sorting nexin 14
  ENST ID: ENST00000369635
  CDS Start-End: 68-619
gtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctcc

SEQ ID NO: 184948 - DNA, 636 bp, Homo sapiens
  Payload ID: 16414
  Gene Symbol: SNX14
  Gene Name: sorting nexin 14
  ENST ID: ENST00000418862
  CDS Start-End: 1-636
gatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagactt

SEQ ID NO: 184949 - DNA, 2259 bp, Homo sapiens
  Payload ID: 16414
  Gene Symbol: SNX14
  Gene Name: sorting nexin 14
  ENST ID: ENST00000513865
  CDS Start-End: 88-2085
gtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaaggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtgattgag

SEQ ID NO: 184950 - DNA, 543 bp, Homo sapiens
  Payload ID: 16414
  Gene Symbol: SNX14
  Gene Name: sorting nexin 14
  ENST ID: ENST00000508658
  CDS Start-End: 1-536
ttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtaactgaaaagcagtaattttatt

SEQ ID NO: 184951 - DNA, 505 bp, Homo sapiens
  Payload ID: 16414
  Gene Symbol: SNX14
  Gene Name: sorting nexin 14
  ENST ID: ENST00000509338
  CDS Start-End: 69-505
gtggggctgggcccagccggacgcgacctcagcctgcggcggctaactgccggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgca

SEQ ID NO: 184952 - DNA, 863 bp, Homo sapiens
  Payload ID: 16414
  Gene Symbol: SNX14
  Gene Name: sorting nexin 14
  ENST ID: ENST00000514419
  CDS Start-End: 154-863
agccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaag

SEQ ID NO: 184953 - DNA, 3288 bp, Homo sapiens
  Payload ID: 16414
  Gene Symbol: SNX14
  Gene Name: sorting nexin 14
  ENST ID: ENST00000515216
  CDS Start-End: 790-3288
atgaaagagattgtggatatgacaaaaaaggtctttcagcataaggatcttacagaaattcaagagccagtagacatcacaccagaggaattaacataatataacttgataaagatgagtgctttggaaccagtgctagacagtgaggaagaagactttgaagaaacagtgccaggggccaaatgcagtggctcatgcctgtaatgccagcattttgggaggccaaggtggatggctcacttgagcccaggagttcaagcctgggtaacacggtgaaaccctgtctctacaaaaaatacaaaaaatttagctggatgtggaggtacacgtctgtagtcccagctacatggggggctgaggtggggaagatcagttgagcctgggatgcagtgagccatgatggcaccactgcactccagctgggatgacagagtgagactctatctcaaaaaaaaaaaaaaaaaaaaagtggtgccagaacacaaattgacagtagacaatatggcagaaggttttcaattatcaagactgcttttcacttcttttatcacatggacccttctttgatactggcactgaatctaaagcaaatggtagaagaaagatcagtactatataaaaatgtttttagagaaatgaaacggcaaaaagtcgggcagaaatcatgatgtacttctataaagtcgagtgtgcctgccacttctgcatccccttctacctctttcacccctgcaattcctcagacagcaagaccaacccctcctcttcagcctacccagtgtgaagacaatgaagatgaagacctttgtgataatccacttccacttaatacagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacaggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcag

SEQ ID NO: 184954 - DNA, 530 bp, Homo sapiens
  Payload ID: 16414
  Gene Symbol: SNX14
  Gene Name: sorting nexin 14
  ENST ID: ENST00000513869
  CDS Start-End: 41-316
tcagcctgcggcggctaactgccggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagctt

SEQ ID NO: 184955 - DNA, 3193 bp, Homo sapiens
  Payload ID: 16414
  Gene Symbol: SNX14
  Gene Name: sorting nexin 14
  Uniprot ID: Q9Y5W7
  ENST ID: ENST00000505648
  CDS Start-End: 340-3024
gtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtga

SEQ ID NO: 184956 - DNA, 771 bp, Homo sapiens
  Payload ID: 16415
  Gene Symbol: SNX15
  Gene Name: sorting nexin 15
  Uniprot ID: Q9NRS6
  ENST ID: ENST00000352068
  CDS Start-End: 1-771
atgtcccgccaggcgaaggatgacttcctgcggcactacacagtgtcggaccccaggactcaccccaagggctacaccgagtacaaagtaaccgcgcagttcatctcaaagaaggacccagaggatgtcaaagaggtggtggtctggaagcggtacagcgacttccgcaagctgcatggagacctggcctacacccaccgcaacctcttccgccgcctcgaggagttccctgctttcccccgggcccaggtgtttggccggtttgaagcctcagtgatcgaggagcggcgaaagggggcagaggacctgcttcgcttcactgtgcacatacctgcgctcaacaacagcccccagctcaaggagttcttccggggtggggaggtgacccgacccttggaggtgtccagggacctacacatcctgccaccccctctgatccccaccccgccccctgatgacccccggctatcccaactgctccctgcagaaaggaggggcctcgaggaattggaggtgccagtggaccccccaccatccagccctgcccaggaggccctggatctcctctttaactgtgagagcaccgaggaggcatctggttcccctgcccgaggccccctcaccgaggctgagcttgccctcttcgaccccttctccaaggaaggtgacccgttgcctgcccgccaggaaggtgtgaagaagaaggcagctgagtacctgaagcgggcagaggagatcctgcgcctgcacctgtctcaactcccaccctaa

SEQ ID NO: 184957 - DNA, 1939 bp, Homo sapiens
  Payload ID: 16415
  Gene Symbol: SNX15
  Gene Name: sorting nexin 15
  Uniprot ID: Q9NRS6
  ENST ID: ENST00000377244
  CDS Start-End: 131-1159
gacaaaatccctaggccagaggaagaagagcgcaggcctggcgaggcggcggcgggcggaggctgggccggaggggtggggacggcgaggaggtggaggccggcgctccgctccgctccagctcggtttcatgtcccgccaggcgaaggatgacttcctgcggcactacacagtgtcggaccccaggactcaccccaagggctacaccgagtacaaagtaaccgcgcagttcatctcaaagaaggacccagaggatgtcaaagaggtggtggtctggaagcggtacagcgacttccgcaagctgcatggagacctggcctacacccaccgcaacctcttccgccgcctcgaggagttccctgctttcccccgggcccaggtgtttggccggtttgaagcctcagtgatcgaggagcggcgaaagggggcagaggacctgcttcgcttcactgtgcacatacctgcgctcaacaacagcccccagctcaaggagttcttccggggtggggaggtgacccgacccttggaggtgtccagggacctacacatcctgccaccccctctgatccccaccccgccccctgatgacccccggctatcccaactgctccctgcagaaaggaggggcctcgaggaattggaggtgccagtggaccccccaccatccagccctgcccaggaggccctggatctcctctttaactgtgagagcaccgaggaggcatctggttcccctgcccgaggccccctcaccgaggctgagcttgccctcttcgaccccttctccaaggaagaaggcgcagcccccagccccacccatgtggctgagctggcaacgatggaggtggagtctgcaaggctggaccaggaaccctgggagccaggagggcaggaggaggaagaggatggggaaggagggcccacccctgcctacctaagccaggccacagagctcatcacccaggccctgcgggatgagaaggcaggcgcttacgctgctgcactccagggctatcgagacggcgtgcacgtcttgcttcagggagtccccagtgacccgttgcctgcccgccaggaaggtgtgaagaagaaggcagctgagtacctgaagcgggcagaggagatcctgcgcctgcacctgtctcaactcccaccctaacagggagtgggccattccctgggactctcgctcctgcactgccagccccttctcctctccccagggcctggccctacctcctggtcttgtaattacaggagccatttctgtaggtaactggaccaagaatgagaaaaataatgaattcttagctccctgattacacctgccaccttggaatcaaggactcacacttctgaccctgcctgtctttttggggtttttttgagttggagtctcgctgtgtcgcccagactggagtgcagtggtgggatcgcggctcactgcaacctccacctcccaggttcaagcagttctcctgtctcagcctccccagtagctgagattgcaggcacatgccaccacgcccagctaatattttgtattttcagtagggacggggttacaccatgttggccaggctggtctcgaactcctgacctcaagtgatccacccgcctcagtctcccaaagtgctgagattacaggcatgagtcactacgcccggcccatgtctgtctgtcttgatgtgtgagcagcagctgtggtcattaaaccattagtttacccctctagaactggggtctgcaaactcccacctgcagccaaatctggcccacctcctttttaatgtaagggctgtgagagtggtttttactttttttaatgattaaaaaaatcaaaataatattctgtgacaatgacaggtgaaatttatatgtgacaagtgaaaattatatgaaatttaagagtccataaataaaatttgttggaacacaa

SEQ ID NO: 184958 - DNA, 627 bp, Homo sapiens
  Payload ID: 16415
  Gene Symbol: SNX15
  Gene Name: sorting nexin 15
  ENST ID: ENST00000524831
  CDS Start-End: 52-627
ggacggcgaggaggtggaggccggcgctccgctccgctccagctcggtttcatgtcccgccaggcgaaggatgacttcctgcggcactacacagtgtcggaccccaggactcaccccaagggctacaccgagtacaaagtaaccgcgcaggtggtggtctggaagcggtacagcgacttccgcaagctgcatggagacctggcctacacccaccgcaacctcttccgccgcctcgaggagttccctgctttcccccgggcccaggtgtttggccggtttgaagcctcagtgatcgaggagcggcgaaagggggcagaggacctgcttcgcttcactgtgcacatacctgcgctcaacaacagcccccagctcaaggagttcttccggggtggggaggtgacccgacccttggaggtgtccagggacctacacatcctgccaccccctctgatccccaccccgccccctgatgacccccggctatcccaactgctccctgcagaaaggaggggcctcgaggaattggaggtgccagtggaccccccaccatccagccctgcccaggaggccctggatctcctctttaactgtgagagcaccgaggaggcatctggttcccctgcccga

SEQ ID NO: 184959 - DNA, 573 bp, Homo sapiens
  Payload ID: 16415
  Gene Symbol: SNX15
  Gene Name: sorting nexin 15
  ENST ID: ENST00000529673
  CDS Start-End: 67-411
gggccggaggggtggggacggcgaggaggtggaggccggcgctccgctccgctccagctcggtttcatgtcccgccaggcgaaggatgacttcctgcggcactacacagtgtcggaccccaggactcaccccaagggctacaccgagtacaaagtaaccgcgcagttcatctcaaagaaggacccagaggatgtcaaagaggtgaggctcctgggaggaagagggactgttctgcagttccagatctggaaactgtcaaggggcagctggtggtggtctggaagcggtacagcgacttccgcaagctgcatggagacctggcctacacccaccgcaacctcttccgccgcctcgaggagttccctgctttcccccgggcccaggtgtttggccggtttgaagcctcagtgatcgaggagcggcgaaagggggcagaggacctgcttcgcttcactgtgcacatacctgcgctcaacaacagcccccagctcaaggagttcttccggggtggggaggtgacccgacccttggaggtgtccagggacctacacatcctgccaccccctctgatcc

SEQ ID NO: 184960 - DNA, 312 bp, Homo sapiens
  Payload ID: 16415
  Gene Symbol: SNX15
  Gene Name: sorting nexin 15
  ENST ID: ENST00000525648
  CDS Start-End: 115-312
aggcgaaggatgacttcctgcggcactacacagtgtcggaccccaggactcaccccaagggctacaccgagtacaaagtaaccgcgcagttcatctcaaagaaggacccagaggatgtcaaagaggtggtggtctggaagcggtacagcgacttccgcaagctgcatggagacctggcctacacccaccgcaacctcttccgccgcctcgaggagttccctgctttcccccgggcccaggtgtttgggtggggaggtgacccgacccttggaggtgtccagggacctacacatcctgccaccccctctgatc

SEQ ID NO: 184961 - DNA, 704 bp, Homo sapiens
  Payload ID: 16415
  Gene Symbol: SNX15
  Gene Name: sorting nexin 15
  ENST ID: ENST00000534637
  CDS Start-End: 53-704
gggacggcgaggaggtggaggccggcgctccgctccgctccagctcggtttcatgtcccgccaggcgaaggatgacttcctgcggcactacacagtgtcggaccccaggactcaccccaagggctacaccgagtacaaattcatctcaaagaaggacccagaggatgtcaaagaggtggtggtctggaagcggtacagcgacttccgcaagctgcatggagacctggcctacacccaccgcaacctcttccgccgcctcgaggagttccctgctttcccccgggcccaggtgtttggccggtttgaagcctcagtgatcgaggagcggcgaaagggggcagaggacctgcttcgcttcactgtgcacatacctgcgctcaacaacagcccccagctcaaggagttcttccggggtggggaggtgacccgacccttggaggtgtccagggacctacacatcctgccaccccctctgatccccaccccgccccctgatgacccccggctatcccaactgctccctgcagaaaggaggggcctcgaggaattggaggtgccagtggaccccccaccatccagccctgcccaggaggccctggatctcctctttaactgtgagagcaccgaggaggcatctggttcccctgcccgaggccccctcaccgaggctgagcttgccctcttcgaccccttctccaaggaag

SEQ ID NO: 184962 - DNA, 3032 bp, Homo sapiens
  Payload ID: 16416
  Gene Symbol: SNX16
  Gene Name: sorting nexin 16
  Uniprot ID: P57768
  ENST ID: ENST00000353788
  CDS Start-End: 169-1116
ctgcggttaaggagagtccggtttaaccgtcaccgggaagcgcgctcgttcgggatcgccgagggggctgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtaattttaaacagacaagtgttcctgatcaaatggataatacttcatctgtctgtagcagtcccctcattaggactaaatttacaggtacagcttcttccattgagtattctactagaccaagagacactgaagaacaaaatccggaaacagtgaattgggaagatagaccatctacacctactatactgggttatgaagtgatggaagaaagagctaaatttactttaaaagagatgtttccaggttttcgactagcacttcctccaaaacgctggtttaaagataattacaatgctgactttttagaagacagacaattaggattacaagcgtttcttcaaaatttagtagctcacaaggacattgctaactgccttgcagtgagagaatttctttgtttggatgatccaccgggtccatttgatagcctagaagaaagcagggcattctgtgaaactttagaagagacaaactaccgcttacagaaagaactacttgaaaaacaaaaggagatggaatcactaaagaaactgctcagtgagaagcaacttcatatagacactttagagaacagaatcagaacattgtctttagaacctgaagaatcactggatgtgtcagaaacagaaggtgaacagatcctaaaggtggagtcctctgcacttgaggttgatcaagatgtcctggatgaagaatctagagctgataataaaccatgcttaagttttagtgaacctgaaaatgctgtatcagagatagaagtagcagaagtggcatatgatgctgaagaagactaatgtatcacaagcagttccctccatttagactattcaaaaatttagaagagtggcaaatactattttaaaagaagaaccaagaactgtaaaacatatagaaaagagcaagaatgcacatgtataaagtttacataaagaagtttttttaagttattgagataggaaatatattcactgctgcttttaattgtattttatccaattacatttaatacactaaaaaaaatcttgttggaattctgttatcaaggcccacattcttaaatactgtgcataaattattatggtgttttgcctatatattgctccaaactactgtgtatatatgtatgtgtgttaaatcaccaattatattaatcaaatggaaattaattgcatgttactatctgggtgatatattcttctttatatctctgacatgacatattttcattaatagtttaaatcagtgaccatcataataaagataaaatttagttgagtttttaatgtttacatgtttacatctctaaataaaatttgcttatttgaaatgttaatgctctttagaaaaatgactttctagtaccaaaggaaaactacttgaaagagctgtaatcatatagctaaagtgataagatagccttgattttaaaagctgattcattaatatcaaaatactttaataagtgtcacagttattaatatgttacatttgtttagtttccacgtaatctttatctctacctagatttagtgagtttgcctctttcagaatactacctccttttgttaaggcatattctttcgaaaatatagattctaaataaataggggcttatacaaaaaagaaaataaaaagccatatatactgcaaagttcctaactggcttgactcctgacattgcatttttatttctatttgtgtgaagatgttgttatactgtattatggctgattttctttttaatatatttagccaagtgatgcactttatgataattaaactcttttgtgccaagtttaattggtggatttttttagtaagtagagttaggagaaagaattatgtagtgcctttactatttcactttctacaaaagtctcctagggtctttgagtcagctttatgaaaaaatgtttgtttatttcagctttgtgtacagtcattaaaagtgccttgtttcatttttataggatgaagttatttattttctattttcactgttttgcatattgctgttaataagcattgtaatcatgctggcattttgcaatcccagtcggtatgctttctaaaaactgagggaaacttactggggaaatagaataacaatctccatttttttctttactatctaaaagtttatcggtatcttgatgtatatatatattaaggtgtggctgtttaaaattctaatgacatatatcaacacattcaatggctgttgttaacctttgaagtaaaaaggagatcactttttaccaaataaccaaaaatttttagtctgtcaaagtgcacaggtatgttctcagaacatttttcacaatgtgtatcagaaatatgtttgctatccttagagacagaaatgaatataataaattgatctgcttatttattaaaattattattctagacttacaaaaggcttaaaaagaacaatcatttaatcagtaccattctgtatcttatataacagatctttgccaaattctagatattatagtgttgcctgtctgttctaaagcgaaccagccactttttcaatctggctttttggaagattgtatttaaagttcttcaaggatgaagaaaaaaatctgttaattaggtaaaccactattatttatatttataatttacttttttttacttttataatgcattttactcccagtattatgttcatttaataaattattttttcactacaaca

SEQ ID NO: 184963 - DNA, 1853 bp, Homo sapiens
  Payload ID: 16416
  Gene Symbol: SNX16
  Gene Name: sorting nexin 16
  Uniprot ID: P57768
  ENST ID: ENST00000345957
  CDS Start-End: 280-1314
acacagcagggatcttgggcccgggcagagactggctgaggcggggagcagctgcttttggggcgggggtgtcacgtgaggcttctcgctgctgagggaggaggcgaaaagctgcggttaaggagagtccggtttaaccgtcaccgggaagcgcgctcgttcgggatcgccgagggggctgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtaattttaaacagacaagtgttcctgatcaaatggataatacttcatctgtctgtagcagtcccctcattaggactaaatttacaggtacagcttcttccattgagtattctactagaccaagagacactgaagaacaaaatccggaaacagtgaattgggaagatagaccatctacacctactatactgggttatgaagtgatggaagaaagagctaaatttactgtatataaaatactagtaaagaaaaccccagaagaaagctgggtagttttcagaagatacactgacttctctaggcttaatgacaaattaaaagagatgtttccaggttttcgactagcacttcctccaaaacgctggtttaaagataattacaatgctgactttttagaagacagacaattaggattacaagcgtttcttcaaaatttagtagctcacaaggacattgctaactgccttgcagtgagagaatttctttgtttggatgatccaccgggtccatttgatagcctagaagaaagcagggcattctgtgaaactttagaagagacaaactaccgcttacagaaagaactacttgaaaaacaaaaggagatggaatcactaaagaaactgctcagtgagaagcaacttcatatagacactttagagaacagaatcagaacattgtctttagaacctgaagaatcactggatgtgtcagaaacagaaggtgaacagatcctaaaggtggagtcctctgcacttgaggttgatcaagatgtcctggatgaagaatctagagctgataataaaccatgcttaagttttagtgaacctgaaaatgctgtatcagagatagaagtagcagaagtggcatatgatgctgaagaagactaatgtatcacaagcagttccctccatttagactattcaaaaatttagaagagtggcaaatactattttaaaagaagaaccaagaactgtaaaacatatagaaaagagcaagaatgcacatgtataaagtttacataaagaagtttttttaagttattgagataggaaatatattcactgctgcttttaattgtattttatccaattacatttaatacactaaaaaaaatcttgttggaattctgttatcaaggcccacattcttaaatactgtgcataaattattatggtgttttgcctatatattgctccaaactactgtgtatatatgtatgtgtgttaaatcaccaattatattaatcaaatggaaattaattgcatgttactatctgggtgatatattcttctttatatctctgacatgacatattttcattaatagtttaaatcagtgaccatcataataaagataaaatttagttgagtttttaatgtttacatgtttacatctctaaataaaatttgcttatttgaaatgttaa

SEQ ID NO: 184964 - DNA, 3452 bp, Homo sapiens
  Payload ID: 16416
  Gene Symbol: SNX16
  Gene Name: sorting nexin 16
  Uniprot ID: P57768
  ENST ID: ENST00000396330
  CDS Start-End: 508-1542
gcccgggcagagactggctgaggcggggagcagctgcttttggggcgggggtgtcacgtgaggcttctcgctgctgagggaggaggcgaaaagctgcggttaaggagagtccggtttaaccgtcaccgggaagcgcgctcgttcgggatcgccgagggggctgagtactgtcaagatgataagcatggaataaagcttcagaagggtctttaccaatctttctcctaccaacttttacatacatgaaatcaggttaaaatgaactttacagaaatacttcacaagggaataaagtagaggaaaaagggataacatgtaacatggagtcaaggaaaaagagtgtgaagtagttttgctctctctatcttgcaaataggagtccttaaagacaactgggagaaggggtttgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtaattttaaacagacaagtgttcctgatcaaatggataatacttcatctgtctgtagcagtcccctcattaggactaaatttacaggtacagcttcttccattgagtattctactagaccaagagacactgaagaacaaaatccggaaacagtgaattgggaagatagaccatctacacctactatactgggttatgaagtgatggaagaaagagctaaatttactgtatataaaatactagtaaagaaaaccccagaagaaagctgggtagttttcagaagatacactgacttctctaggcttaatgacaaattaaaagagatgtttccaggttttcgactagcacttcctccaaaacgctggtttaaagataattacaatgctgactttttagaagacagacaattaggattacaagcgtttcttcaaaatttagtagctcacaaggacattgctaactgccttgcagtgagagaatttctttgtttggatgatccaccgggtccatttgatagcctagaagaaagcagggcattctgtgaaactttagaagagacaaactaccgcttacagaaagaactacttgaaaaacaaaaggagatggaatcactaaagaaactgctcagtgagaagcaacttcatatagacactttagagaacagaatcagaacattgtctttagaacctgaagaatcactggatgtgtcagaaacagaaggtgaacagatcctaaaggtggagtcctctgcacttgaggttgatcaagatgtcctggatgaagaatctagagctgataataaaccatgcttaagttttagtgaacctgaaaatgctgtatcagagatagaagtagcagaagtggcatatgatgctgaagaagactaatgtatcacaagcagttccctccatttagactattcaaaaatttagaagagtggcaaatactattttaaaagaagaaccaagaactgtaaaacatatagaaaagagcaagaatgcacatgtataaagtttacataaagaagtttttttaagttattgagataggaaatatattcactgctgcttttaattgtattttatccaattacatttaatacactaaaaaaaatcttgttggaattctgttatcaaggcccacattcttaaatactgtgcataaattattatggtgttttgcctatatattgctccaaactactgtgtatatatgtatgtgtgttaaatcaccaattatattaatcaaatggaaattaattgcatgttactatctgggtgatatattcttctttatatctctgacatgacatattttcattaatagtttaaatcagtgaccatcataataaagataaaatttagttgagtttttaatgtttacatgtttacatctctaaataaaatttgcttatttgaaatgttaatgctctttagaaaaatgactttctagtaccaaaggaaaactacttgaaagagctgtaatcatatagctaaagtgataagatagccttgattttaaaagctgattcattaatatcaaaatactttaataagtgtcacagttattaatatgttacatttgtttagtttccacgtaatctttatctctacctagatttagtgagtttgcctctttcagaatactacctccttttgttaaggcatattctttcgaaaatatagattctaaataaataggggcttatacaaaaaagaaaataaaaagccatatatactgcaaagttcctaactggcttgactcctgacattgcatttttatttctatttgtgtgaagatgttgttatactgtattatggctgattttctttttaatatatttagccaagtgatgcactttatgataattaaactcttttgtgccaagtttaattggtggatttttttagtaagtagagttaggagaaagaattatgtagtgcctttactatttcactttctacaaaagtctcctagggtctttgagtcagctttatgaaaaaatgtttgtttatttcagctttgtgtacagtcattaaaagtgccttgtttcatttttataggatgaagttatttattttctattttcactgttttgcatattgctgttaataagcattgtaatcatgctggcattttgcaatcccagtcggtatgctttctaaaaactgagggaaacttactggggaaatagaataacaatctccatttttttctttactatctaaaagtttatcggtatcttgatgtatatatatattaaggtgtggctgtttaaaattctaatgacatatatcaacacattcaatggctgttgttaacctttgaagtaaaaaggagatcactttttaccaaataaccaaaaatttttagtctgtcaaagtgcacaggtatgttctcagaacatttttcacaatgtgtatcagaaatatgtttgctatccttagagacagaaatgaatataataaattgatctgcttatttattaaaattattattctagacttacaaaaggcttaaaaagaacaatcatttaatcagtaccattctgtatcttatataacagatctttgccaaattctagatattatagtgttgcctgtctgttctaaagcgaaccagccactttttcaatctggctttttggaagattgtatttaaagttcttcaaggatgaagaaaaaaatctgttaattaggtaaaccactattatttatatttataatttacttttttttacttttataatgcattttactcccagtattatgttcatttaataaattattttttcact

SEQ ID NO: 184965 - DNA, 742 bp, Homo sapiens
  Payload ID: 16416
  Gene Symbol: SNX16
  Gene Name: sorting nexin 16
  ENST ID: ENST00000519119
  CDS Start-End: 524-742
acagcagggatcttgggcccgggcagagactggctgaggcggggagcagctgcttttggggcgggggtgtcacgtgaggcttctcgctgctgagggaggaggcgaaaagctgcggttaaggagagtccggtttaaccgtcaccgggaagcgcgctcgttcgggatcgccgagggggctgagtactgtcaagatgataagcatggaataaagcttcagaagggtctttaccaatctttctcctaccaacttttacatacatgaaatcaggttaaaatgaactttacagaaatacttcacaagggaataaagtagaggaaaaagggataacatgtaacatggagtcaaggaaaaagagtgtgaagtagttttgctctctctatcttgcaaataggagtccttaaagacaactgggagaaggggtttgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtacagcttcttccattgagtattctactagaccaagagacactgaagaacaaaatccggaaacagtgaat

SEQ ID NO: 184966 - DNA, 691 bp, Homo sapiens
  Payload ID: 16416
  Gene Symbol: SNX16
  Gene Name: sorting nexin 16
  ENST ID: ENST00000518183
  CDS Start-End: 439-691
gctgctgagggaggaggcgaaaagctgcggttaaggagagtccggtttaaccgtcaccgggaagcgcgctcgttcgggatcgccgagggggctgagtactgtcaagatgataagcatggaataaagcttcagaagggtctttaccaatctttctcctaccaacttttacatacatgaaatcaggttaaaatgaactttacagaaatacttcacaagggaataaagtagaggaaaaagggataacatgtaacatggagtcaaggaaaaagagtgtgaagtagttttgctctctctatcttgcaaataggagtccttaaagacaactgggagaaggggtttgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtaattttaaacagacaagtgttcctgatcaaatggataatacttcatctgtctgtagcagtcccctcattaggactaaatttacaggtacagcttcttccattg

SEQ ID NO: 184967 - DNA, 880 bp, Homo sapiens
  Payload ID: 16416
  Gene Symbol: SNX16
  Gene Name: sorting nexin 16
  ENST ID: ENST00000519817
  CDS Start-End: 604-880
gtgcgtctgggaggcgctgggcgcgcaccggtcagcggaggcgggagagtctgtgatcccagggagctgcgggtctcgccgcctgcagtgcggaagacccgtgaccggcgcagaccccggccttaccttccgagggtcgaactgtgcctggtatttgcctctttcctcccgcccacggggttgctcagagtcgggccacctcacctgaggttttccagagtgagaatgaactgagcgtcctgggagcaactccgcatcaggtactgtcaagatgataagcatggaataaagcttcagaagggtctttaccaatctttctcctaccaacttttacatacatgaaatcaggttaaaatgaactttacagaaatacttcacaagggaataaagtagaggaaaaagggataacatgtaacatggagtcaaggaaaaagagtgtgaagtagttttgctctctctatcttgcaaataggagtccttaaagacaactgggagaaggggtttgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtaattttaaacagacaagtgttcctgatcaaatggataatacttcatctgtctgtagcagtcccctcattaggactaaatttacaggtacagcttcttccattgagtattctactagaccaagagaca

SEQ ID NO: 184968 - DNA, 669 bp, Homo sapiens
  Payload ID: 16416
  Gene Symbol: SNX16
  Gene Name: sorting nexin 16
  ENST ID: ENST00000520618
  CDS Start-End: 182-669
aggaggcgaaaagctgcggttaaggagagtccggtttaaccgtcaccgggaagcgcgctcgttcgggatcgccgagggggctgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtaattttaaacagacaagtgttcctgatcaaatggataatacttcatctgtctgtagcagtcccctcattaggactaaatttacaggtacagcttcttccattgagtattctactagaccaagagacactgaagaacaaaatccggaaacagtgaattgggaagatagaccatctacacctactatactgggttatgaagtgatggaagaaagagctaaatttactgcattctgtgaaactttagaagagacaaactaccgcttacagaaagaactacttgaaaaacaaaaggagatggaatcactaaagaaactgctcagtgagaagcaacttcatat

SEQ ID NO: 184969 - DNA, 804 bp, Homo sapiens
  Payload ID: 16416
  Gene Symbol: SNX16
  Gene Name: sorting nexin 16
  ENST ID: ENST00000521810
  CDS Start-End: 194-804
gatgactacaagtcccatgatgcaaagtatgagcacggaccaatgttggtcgcagttccttctgggaattgtagtcttctcctgtttggcaaactagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtaattttaaacagacaagtgttcctgatcaaatggataatacttcatctgtctgtagcagtcccctcattaggactaaatttacaggtacagcttcttccattgagtattctactagaccaagagacactgaagaacaaaatccggaaacagtgaattgggaagatagaccatctacacctactatactgggttatgaagtgatggaagaaagagctaaatttactgtatataaaatactagtaaagaaaaccccagaagaaagctgggtagttttcagaagatacactgacttctctaggcttaatgacaaattaaaagagatgtttccaggttttcgactagcacttcctccaaaacgctggtttaaagataattacaatgctgactttttagaagacagacaattaggattacaagcgtttcttcaaaatttagtagctcacaaggacattgctaactg

SEQ ID NO: 184970 - DNA, 682 bp, Homo sapiens
  Payload ID: 16416
  Gene Symbol: SNX16
  Gene Name: sorting nexin 16
  ENST ID: ENST00000523757
  CDS Start-End: 159-682
ggagagtccggtttaaccgtcaccgggaagcgcgctcgttcgggatcgccgagggggctgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtacagcttcttccattgagtattctactagaccaagagacactgaagaacaaaatccggaaacagtgaattgggaagatagaccatctacacctactatactgggttatgaagtgatggaagaaagagctaaatttactgtatataaaatactagtaaagaaaaccccagaagaaagctgggtagttttcagaagatacactgacttctctaggcttaatgacaaattaaaagagatgtttccaggttttcgactagcacttcctccaaaacgctggtttaaagataattacaatgctgactttttagaagacagacaattaggattacaagcgtttcttcaaaatttagtagctcacaaggacattgctaactg

SEQ ID NO: 184971 - DNA, 577 bp, Homo sapiens
  Payload ID: 16416
  Gene Symbol: SNX16
  Gene Name: sorting nexin 16
  ENST ID: ENST00000521773
  CDS Start-End: 469-577
caaccttgatgtctggcgggcggcaaggggctccgcgggagagtggagaggcgccgcaggaagcccagccaccttcaggccaccgccgaccccactgtgcgtctgggaggcgctgggcgcgcaccgtactgtcaagatgataagcatggaataaagcttcagaagggtctttaccaatctttctcctaccaacttttacatacatgaaatcaggttaaaatgaactttacagaaatacttcacaagggaataaagtagaggaaaaagggataacatgtaacatggagtcaaggaaaaagagtgtgaagtagttttgctctctctatcttgcaaataggagtccttaaagacaactgggagaaggggtttgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagct

SEQ ID NO: 184972 - DNA, 1918 bp, Homo sapiens
  Payload ID: 16416
  Gene Symbol: SNX16
  Gene Name: sorting nexin 16
  ENST ID: ENST00000615066
  CDS Start-End: 113-1144
ggagaaggggtttgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtaattttaaacagacaagtgttcctgatcaaatggataatacttcatctgtctgtagcagtcccctcattaggactaaatttacaggtacagcttcttccattgagtattctactagaccaagagacactgaagaacaaaatccggaaacagtgaattgggaagatagaccatctacacctactatactgggttatgaagtgatggaagaaagagctaaatttactgtatataaaatactagtaaagaaaaccccagaagaaagctgggtagttttcagaagatacactgacttctctaggcttaatgacaaattaaaagagatgtttccaggttttcgactagcacttcctccaaaacgctggtttaaagataattacaatgctgactttttagaagacagacaattaggattacaagcgtttcttcaaaatttagtagctcacaaggacattgctaactgccttgcagtgagagaatttctttgtttggatgatccaccgggtccatttgatagcctagaagaaagcagggcattctgtgaaactttagaagagacaaactaccgcttacagaaagaactacttgaaaaacaaaaggagatggaatcactaaagaaactgctcagtgagaagcaacttcatatagacactttagagaacagaatcagaacattgtctttagaacctgaagaatcactggatgtgtcagaaacagaaggtgaacagatcctaaaggtggagtcctctgcacttgaggttgatcaagatgtctggatgagatctagagctgataataaaccatgcttaagttttagtgaacctgaaaatgctgtatcagagatagaagtagcagaagtggcatatgatgctgaagaagactaatgtatcacaagcagttccctccatttagactattcaaaaatttagaagagtggcaaatactattttaaaagaagaaccaagaactgtaaaacatatagaaaagagcaagaatgcacatgtataaagtttacataaagaagtttttttaagttattgagataggaaatatattcactgctgcttttaattgtattttatccaattacatttaatacactaaaaaaaatcttgttggaattctgttatcaaggcccacattcttaaatactgtgcataaattattatggtgttttgcctatatattgctccaaactactgtgtatatatgtatgtgtgttaaatcaccaattatattaatcaaatggaaattaattgcatgttactatctgggtgatatattcttctttatatctctgacatgacatattttcattaatagtttaaatcagtgaccatcataataaagataaaatttagttgagtttttaatgtttacatgtttacatctctaaataaaatttgcttatttgaaatgttaatgctctttagaaaaatgactttctagtaccaaaggaaaactacttgaaagagctgtaatcatatagctaaagtgataagatagccttgattttaaaagctgattcattaatatcaaaatactttaataagtgtcacagttattaatatgttacatttgtttagtttccacgtaatctttatctctacctagatttagtgagtttgcctctttcagaatactacctccttttgtta

SEQ ID NO: 184973 - DNA, 2044 bp, Homo sapiens
  Payload ID: 16417
  Gene Symbol: SNX17
  Gene Name: sorting nexin 17
  Uniprot ID: Q15036
  ENST ID: ENST00000233575
  CDS Start-End: 223-1635
ccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgccta

SEQ ID NO: 184974 - DNA, 1955 bp, Homo sapiens
  Payload ID: 16417
  Gene Symbol: SNX17
  Gene Name: sorting nexin 17
  ENST ID: ENST00000440760
  CDS Start-End: 128-289
atcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcaggtgggactagcacccctgccttgagacagcttcaagcccttccctacacgtggacatcagtgtctccctttacccgctcttcttgttcccgtaggctgtagttcccctttaatcactgccacaggttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcct

SEQ ID NO: 184975 - DNA, 1638 bp, Homo sapiens
  Payload ID: 16417
  Gene Symbol: SNX17
  Gene Name: sorting nexin 17
  ENST ID: ENST00000453453
  CDS Start-End: 80-289
ctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgccta

SEQ ID NO: 184976 - DNA, 2007 bp, Homo sapiens
  Payload ID: 16417
  Gene Symbol: SNX17
  Gene Name: sorting nexin 17
  ENST ID: ENST00000427123
  CDS Start-End: 117-380
gggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtggcctataacattcacgtgaatggagtcctgcactgtcgggtgcgctacagccagctcctggggctgcacgagcagcttcggaaggagtatggggccaatgtgcttcctgcattccccccaaagaagcttttctctctgactcctgctgaggtagaacagaggagagagcagttagagaagtacatgcaagctgttctatagactggactcacctagatggcagccaagggtggggcaggtgaagaatttatgcaaacagtgagtgagttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgct

SEQ ID NO: 184977 - DNA, 2400 bp, Homo sapiens
  Payload ID: 16417
  Gene Symbol: SNX17
  Gene Name: sorting nexin 17
  Uniprot ID: Q15036
  ENST ID: ENST00000537606
  CDS Start-End: 249-1586
aatgagggccaactccactttgggctccctatccggacaggtggctcttgccctttagactacagttcccagcatgcccaggcgattgcgtcccagaaccgacgtcccaccgccttcccacatcggatcgcagggctcccaaaatggcgagtgaggctgcggggactcgctgagcagcggagggggagcgtgcagagccgctgcggccctcacagtccggagcccggccgtgccgtgccgtagggaacatgcacttttccattcccgaaaccgagtcccgcagcggggacagcggcggctccgcctacgtgcttcggaaggagtatggggccaatgtgcttcctgcattccccccaaagaagcttttctctctgactcctgctgaggtagaacagaggagagagcagttagagaagtacatgcaagctgttcggcaagacccattgcttgggagcagcgagactttcaacagtttcctgcgtcgggcacaacaggagacacagcaggtccccacagaggaagtgtccttggaagtgctgctcagcaacgggcagaaagttctggtcaacgtgctaacttcagatcagactgaggatgtcctggaggctgtagctgcaaagctggatcttccagatgacttgattggatactttagtctattcttagttcgagaaaaagaggatggagccttttcttttgtacggaagttgcaagagtttgagctgccttatgtgtctgtcaccagccttcggagtcaagagtataagattgtgctaaggaagagttattgggactctgcctatgatgacgatgtcatggagaaccgggttggcctgaacctgctttatgctcagacggtatcagatattgagcgtgggtggatcttggtcaccaaggaacagcaccggcaactcaaatctctgcaagagaaagtctccaagaaggagttcctgagactggcccagacgctgcggcactatggctacttgcgctttgatgcctgtgtggctgacttcccagaaaaggactgtcctgtggtggtgagcgcgggcaacagtgagctcagcctgcagctccgcctgcctggccagcaactccgagaaggctccttccgggtcacccgcatgcgatgctggcgggtcacctcctctgtaccattgcccagtggaagcacgagcagcccaggccggggccggggtgaggtgcgcctggaactggcttttgaatacctcatgagcaaggaccggctacagtgggtcaccatcactagcccccaggctatcatgatgagcatctgcttgcagtccatggttgatgaactgatggtgaagaaatctggcggcagtatcaggaagatgctgcgccggcgggtggggggtactctgagacgctcagacagccagcaagcagtgaagtccccaccactgcttgagtcacctgatgccacccgggagtctatggtcaaactctcaagtaagctgagtgccgtgagcttgcggggaattggcagtcccagcacagatgccagtgccagtgatgtccacggcaatttcgccttcgagggcattggagatgaggatctgtaatctccactgcttggatgtctgccctctaccccagaggaatttacagaaacttgccctgtgcctgtgtcccccatgctaggggcggaggggtcttttccttcttctttcctacctaccccttttctcttggccaggggcctcgtatcctacctttccttgtcccctgggctggctgcacagaggattgccccttctcttttcagagctggccctcgatgccaaattagcatttagtattttgcacaaagtctaagggaccatggctgcctgccttggggaggaaccatatctccctctgggccgcttctggcctcttggagccatgggccaaaggccaaggggatgggcagaggtctgtgtttggtctggcccagttccccatcattaaactcagcctgactgctgcctacctctggttccctctcactgcccctgcttcccccatcacagcatggactactatgctaagggtaaggccaaattgcctgccattgccaattcagcatagacatggctttgttagtgtttcctttattataaagcactgaaataagttaaataaacaggtgggaggctgggcagtcccccagccggtttgtccacagcccctgggggcagtggaggtgaatacagggcccttctcactgagctcgtgaagtgcctcagtcaaggcaaggtcccctggtccatatgggcccccccgcccatggggttgggctggtccttatagtgcctacgttagtctgtgtggagcccctggccagcgggggagaaaaaggtggcttctggtccgtctgtataaaacatggggaag

SEQ ID NO: 184978 - DNA, 2152 bp, Homo sapiens
  Payload ID: 16418
  Gene Symbol: SNX18
  Gene Name: sorting nexin 18
  Uniprot ID: Q96RF0
  ENST ID: ENST00000326277
  CDS Start-End: 195-2081
agtcggcgctgcgaagtggaggcgctgcgagcggagccgcgcggagggcgcgaccggctggtccgggcagcgtgggtttgccgccttcggggctccagtccgcgcgccagggctcgagcagtaccgcgggcccctcaggtgggcctcggctcgggacgccgggagtcgggaccgccagtcggggcgccgggaccatggcgctgcgcgcccgggcgctgtacgacttcaggtcggagaacccaggagagatctcgctgcgagagcacgaggtgctgagcctgtgcagcgagcaggacatcgagggctggctcgagggggtcaacagccgcggcgaccgcggcctcttcccggcctcctatgtgcaggtgatccgcgcccccgagcctggcccggcgggagacggcggcccgggcgccccggcccgctacgccaatgtgccccccgggggcttcgagcccctgcctgtcgcgccccccgcctccttcaagccgccgcctgacgccttccaggcgctgctgcagccacagcaggcgccgcctccgagcaccttccagccgcccggcgcgggcttcccgtacggcgggggcgccctgcagccgtcgcctcagcagctctacggcggctaccaggccagccaaggcagcgatgatgactgggacgacgagtgggacgacagctccacggtggcggacgagccgggcgctctgggcagcggagcatacccggacctcgacggctcgtcttcggcgggtgtgggcgcagccggccgctaccgcctgtccacgcgctccgacctgtccctgggttcccgcggcggctcggtccccccgcagcaccacccgtcggggcccaagagctcggccaccgtgagccgcaacctcaatcgcttctccaccttcgtcaagtccggcggggaggccttcgtgctgggggaggcgtcaggcttcgtgaaggacggggacaagctgtgcgtggtgctggggccctatggccccgagtggcaggagaacccctacccgttccagtgcaccatcgacgaccccaccaagcagaccaagttcaagggcatgaagagctacatctcctacaagctggtgcccacgcacacgcaggtgccggtgcatcggcgctacaagcacttcgactggctgtacgcgcgcctggcggagaagttcccggtcatctccgtgccccacctgcccgagaagcaggccaccggccgcttcgaggaggacttcatctctaagcgcaggaagggcctgatctggtggatgaaccacatggccagccacccagtgctggcgcagtgcgacgtcttccagcacttcctgacgtgccccagcagcaccgacgagaaagcctggaagcagggcaagaggaaggccgagaaggacgagatggtgggcgccaacttcttcctgacccttagcacgccccccgccgctgcccttgacctgcaggaggtggagagcaagatcgacggcttcaagtgcttcaccaagaagatggacgacagcgcgctgcagctcaaccacacggccaacgagttcgcgcgcaagcaggtgaccggcttcaaaaaggagtatcagaaggtgggccagtccttccgcggcctcagccaggcctttgagctggaccagcaggccttctcggtgggcctgaaccaggctatcgccttcaccggagatgcctatgacgccattggcgagctcttcgcggagcagcccaggcaggacctggatcccgtcatggacctattagcgctgtatcaggggcatctggctaacttcccggacatcatccacgttcagaaaggtaaagcctggcccttagagcaggtgatatggagtgtattgtgcaggctgaaaggggcgactttgacagcagtaccactgtgggtttcagaatcatattctacaggtgaggaagcgagcagagacgtggacgcctgggtcttttccctagagtgtaagttggattgctcgacaggcagcttcctcctcgagtatcttgcattagggaatgagtactctttctcgaaggttcaaagagtacctttgatgacagtgctatcattttagagtttgaatagttgagtaatgagctgctcaaatctgtaatcttgagacgagggtagaattagaaggggacc

SEQ ID NO: 184979 - DNA, 5375 bp, Homo sapiens
  Payload ID: 16418
  Gene Symbol: SNX18
  Gene Name: sorting nexin 18
  Uniprot ID: Q96RF0
  ENST ID: ENST00000343017
  CDS Start-End: 195-1970
agtcggcgctgcgaagtggaggcgctgcgagcggagccgcgcggagggcgcgaccggctggtccgggcagcgtgggtttgccgccttcggggctccagtccgcgcgccagggctcgagcagtaccgcgggcccctcaggtgggcctcggctcgggacgccgggagtcgggaccgccagtcggggcgccgggaccatggcgctgcgcgcccgggcgctgtacgacttcaggtcggagaacccaggagagatctcgctgcgagagcacgaggtgctgagcctgtgcagcgagcaggacatcgagggctggctcgagggggtcaacagccgcggcgaccgcggcctcttcccggcctcctatgtgcaggtgatccgcgcccccgagcctggcccggcgggagacggcggcccgggcgccccggcccgctacgccaatgtgccccccgggggcttcgagcccctgcctgtcgcgccccccgcctccttcaagccgccgcctgacgccttccaggcgctgctgcagccacagcaggcgccgcctccgagcaccttccagccgcccggcgcgggcttcccgtacggcgggggcgccctgcagccgtcgcctcagcagctctacggcggctaccaggccagccaaggcagcgatgatgactgggacgacgagtgggacgacagctccacggtggcggacgagccgggcgctctgggcagcggagcatacccggacctcgacggctcgtcttcggcgggtgtgggcgcagccggccgctaccgcctgtccacgcgctccgacctgtccctgggttcccgcggcggctcggtccccccgcagcaccacccgtcggggcccaagagctcggccaccgtgagccgcaacctcaatcgcttctccaccttcgtcaagtccggcggggaggccttcgtgctgggggaggcgtcaggcttcgtgaaggacggggacaagctgtgcgtggtgctggggccctatggccccgagtggcaggagaacccctacccgttccagtgcaccatcgacgaccccaccaagcagaccaagttcaagggcatgaagagctacatctcctacaagctggtgcccacgcacacgcaggtgccggtgcatcggcgctacaagcacttcgactggctgtacgcgcgcctggcggagaagttcccggtcatctccgtgccccacctgcccgagaagcaggccaccggccgcttcgaggaggacttcatctctaagcgcaggaagggcctgatctggtggatgaaccacatggccagccacccagtgctggcgcagtgcgacgtcttccagcacttcctgacgtgccccagcagcaccgacgagaaagcctggaagcagggcaagaggaaggccgagaaggacgagatggtgggcgccaacttcttcctgacccttagcacgccccccgccgctgcccttgacctgcaggaggtggagagcaagatcgacggcttcaagtgcttcaccaagaagatggacgacagcgcgctgcagctcaaccacacggccaacgagttcgcgcgcaagcaggtgaccggcttcaaaaaggagtatcagaaggtgggccagtccttccgcggcctcagccaggcctttgagctggaccagcaggccttctcggtgggcctgaaccaggctatcgccttcaccggagatgcctatgacgccattggcgagctcttcgcggagcagcccaggcaggacctggatcccgtcatggacctattagcgctgtatcaggggcatctggctaacttcccggacatcatccacgttcagaaaggtaaagcctggcccttagagcaggtgatatggagtgtattgtgcaggctgaaaggggcgactttgacagcagtaccactgtgggtttcagaatcatattctacaggtgaggaagcgagcagagacgtggacgcctgggtcttttccctagagtgagctcttaccaaagtcaaggagagtaggcgacacgtggaggaagggaagatggaggtgcagaaggctgacggcattcaggatcgctgtaacactatttcttttgccactttggctgaaattcaccacttccatcaaattcgagtgagagactttaaatcacagatgcagcatttcttacaacaacaaataatatttttccaaaaagttacccagaagttggaagaagctcttcacaaatatgatagtgtttaatgactggacgttggattatggactttttcagttcaaggataatttctacagcagaataaaaactgctgtcaaagagctattgccagctatcagtggtggtacaaggacggttttgtgttcatctgaaacccagctgaatttataattatgtaggaaataaacagttaatatggttatataatagaaacagtaccacacattgtaactaaattatactatgtatgcctacactaccattgtaacttttggaataatgattatactatttgccttattgctttttgaagtatgggtattttagtgcatactttgtagacctcaaaacccatgaagggtctcaaagaagctggctggatacaagcctgctgtggatgcctttttactctcatagattgggattacctaaattcaacctattctctgtttacaaactccaactagagcagctatgcgaccttgtgcctttagactcttggtttttcatttctccccgtcccttccccacctttttaaagtaagccacagcttttctgattgaaagagtgaaaggccagtgcatataatgacaaactgatgataaccttatattggcagtagggggtggggggggcggtggggtgggacgatcagctgtcatcaatttgcacagcaagtattatctcctgataagatgctggtgaatgcaggggagtgagattcattgctcatctttggatatgaagtctgttagggaagaaacagtgccactattcccttagatgcaacagtagcatagcctcttcacccaggcgtcccaaaagcttggcgtgaagatttcagcaaacatgtcttacaacatgaggaggaggagtctaaatcagtcaggggataaaagtatcgaatcattgacaacacacacttggctttagttcttaggagggttttgtttttgtttttgtttttaggttgaagattttcttttaatattcagttttttgaaaaaaaatggatctacactgttaactgattgagactccactgtgattcacttgtttacttaaaaacttttcagggatgtctgtaaatttcagtgttaatatgtcatgaaaagtggtgtggattgatctaaggagggaccagaaataatttttgctattccaaatactgaaggaaaaagataattgatttatactatgttttaaaaaaaaaaaaggtattgatgagccccccccccccaggacatttaaccttaaaatttattttaaatgtattcttttattattataagggaaatacagatggctgataaataccaaaaagattcaaaagcagcttaatttaaaaagcacaaagagattctggcttacagtgccccaatctcaatgtttttatagttgctgagctaactaatgtgattattgagtttacagatttaaaaattgtcactgttagagtatctactgtttttatgaagtcaaacttatgctgcctcagaaatccctgggtactgaaatggtaacatggaagtgaagaggtcactttgaaatattggtgagtcacaaagattaaagaaaaggatcagtttgcagatactcagaaaaggttattgaaataattactgaacagcacattttctctctaaaaagtagtttcatatgggttgtatttttaagatcagattatcattttgatatttggtcaaaattttgtaccttaggttacttagagccagatttaacatcatgaacattatgtggctttgtctttactacagatatgtggaactgtaaccaaatatgttgtctctaaaacttgttgattgcaaaatacagttctataaacaaaacccatatgtatatataaatgttaattttgcggaagtctggaaattataactatagcatttaagtttgagtctgtattggacaaataagcaccatgcttttcaaatgatttaaaaattacttttatttgcctctttattttgatggtggttggatttttttttttttaatagtaaaatcactaaacttgtgcaatggtagcatggaaattatctgaggtatattgtatgattgtactttagccagggtggacatagcttaaattataaaaactaaagatgaaagtacaaggaagtataagttatacttatgtaagtataaattcatgctgcctacttctaagagaaatttcattcttcataaccacataacattataatgccactgattcatacgggatttacattaattctatgggggaggacactagaattattagtgttcattttcatctaagatctttattctctaacgttcttggtcctattgaaacattgcagtatgcaaaactactgcaatgttaaacccaagagaaaagccattatcatgtgtatgctggtcatcatgatcagtgtggtacaatttttaaaaataaactatcatgcccttcatgccattatttgtctttatttctatgatttataatcctgatatgtgatgtgtttgtaacacagggtgtgcacttgagcctggttttactgtttttattagacagagttgtttatatgctgtaactgtaacgcagcgagactggttctacagccatgtgtcgtaatcttgttccccgtccaagctgttgtatctgaaggtacccagtttgcacccaggatgagggaacgcattcaaaagtgaaatgtaaagccagtgcacgaatattatagtaattgagattttcccaggcttcactgatacagttgttttgcatttattcacaataatacagcagattcttaaatgccgatttttaattgtcttaaattttgctgctgttctcataattaaggacttgaaaaatgttttagtctgtcaagtatgtaaagtttgtgtaaaaacttttaaatgtcattcttaagttcattgccatagccattttccatttatgtcttcattttccaaaaatcaaatgccatgtctgatacctttaagtccataagcattcaattttctcatttccaccttcatctttggttaacagaataagtaaaacagggtattatttatttgtagtctagaaatgttgaatattgttttatttccttcaaaatgttatgattagtgcagatcagccatgtttatctttttaaaaaataaacaggttgctttatttctt

SEQ ID NO: 184980 - DNA, 5218 bp, Homo sapiens
  Payload ID: 16418
  Gene Symbol: SNX18
  Gene Name: sorting nexin 18
  Uniprot ID: Q96RF0
  ENST ID: ENST00000381410
  CDS Start-End: 191-2065
ggcgctgcgaagtggaggcgctgcgagcggagccgcgcggagggcgcgaccggctggtccgggcagcgtgggtttgccgccttcggggctccagtccgcgcgccagggctcgagcagtaccgcgggcccctcaggtgggcctcggctcgggacgccgggagtcgggaccgccagtcggggcgccgggaccatggcgctgcgcgcccgggcgctgtacgacttcaggtcggagaacccaggagagatctcgctgcgagagcacgaggtgctgagcctgtgcagcgagcaggacatcgagggctggctcgagggggtcaacagccgcggcgaccgcggcctcttcccggcctcctatgtgcaggtgatccgcgcccccgagcctggcccggcgggagacggcggcccgggcgccccggcccgctacgccaatgtgccccccgggggcttcgagcccctgcctgtcgcgccccccgcctccttcaagccgccgcctgacgccttccaggcgctgctgcagccacagcaggcgccgcctccgagcaccttccagccgcccggcgcgggcttcccgtacggcgggggcgccctgcagccgtcgcctcagcagctctacggcggctaccaggccagccaaggcagcgatgatgactgggacgacgagtgggacgacagctccacggtggcggacgagccgggcgctctgggcagcggagcatacccggacctcgacggctcgtcttcggcgggtgtgggcgcagccggccgctaccgcctgtccacgcgctccgacctgtccctgggttcccgcggcggctcggtccccccgcagcaccacccgtcggggcccaagagctcggccaccgtgagccgcaacctcaatcgcttctccaccttcgtcaagtccggcggggaggccttcgtgctgggggaggcgtcaggcttcgtgaaggacggggacaagctgtgcgtggtgctggggccctatggccccgagtggcaggagaacccctacccgttccagtgcaccatcgacgaccccaccaagcagaccaagttcaagggcatgaagagctacatctcctacaagctggtgcccacgcacacgcaggtgccggtgcatcggcgctacaagcacttcgactggctgtacgcgcgcctggcggagaagttcccggtcatctccgtgccccacctgcccgagaagcaggccaccggccgcttcgaggaggacttcatctctaagcgcaggaagggcctgatctggtggatgaaccacatggccagccacccagtgctggcgcagtgcgacgtcttccagcacttcctgacgtgccccagcagcaccgacgagaaagcctggaagcagggcaagaggaaggccgagaaggacgagatggtgggcgccaacttcttcctgacccttagcacgccccccgccgctgcccttgacctgcaggaggtggagagcaagatcgacggcttcaagtgcttcaccaagaagatggacgacagcgcgctgcagctcaaccacacggccaacgagttcgcgcgcaagcaggtgaccggcttcaaaaaggagtatcagaaggtgggccagtccttccgcggcctcagccaggcctttgagctggaccagcaggccttctcggtgggcctgaaccaggctatcgccttcaccggagatgcctatgacgccattggcgagctcttcgcggagcagcccaggcaggacctggatcccgtcatggacctattagcgctgtatcaggggcatctggctaacttcccggacatcatccacgttcagaaaggagctcttaccaaagtcaaggagagtaggcgacacgtggaggaagggaagatggaggtgcagaaggctgacggcattcaggatcgctgtaacactatttcttttgccactttggctgaaattcaccacttccatcaaattcgagtgagagactttaaatcacagatgcagcatttcttacaacaacaaataatatttttccaaaaagttacccagaagttggaagaagctcttcacaaatatgatagtgtttaatgactggacgttggattatggactttttcagttcaaggataatttctacagcagaataaaaactgctgtcaaagagctattgccagctatcagtggtggtacaaggacggttttgtgttcatctgaaacccagctgaatttataattatgtaggaaataaacagttaatatggttatataatagaaacagtaccacacattgtaactaaattatactatgtatgcctacactaccattgtaacttttggaataatgattatactatttgccttattgctttttgaagtatgggtattttagtgcatactttgtagacctcaaaacccatgaagggtctcaaagaagctggctggatacaagcctgctgtggatgcctttttactctcatagattgggattacctaaattcaacctattctctgtttacaaactccaactagagcagctatgcgaccttgtgcctttagactcttggtttttcatttctccccgtcccttccccacctttttaaagtaagccacagcttttctgattgaaagagtgaaaggccagtgcatataatgacaaactgatgataaccttatattggcagtagggggtggggggggcggtggggtgggacgatcagctgtcatcaatttgcacagcaagtattatctcctgataagatgctggtgaatgcaggggagtgagattcattgctcatctttggatatgaagtctgttagggaagaaacagtgccactattcccttagatgcaacagtagcatagcctcttcacccaggcgtcccaaaagcttggcgtgaagatttcagcaaacatgtcttacaacatgaggaggaggagtctaaatcagtcaggggataaaagtatcgaatcattgacaacacacacttggctttagttcttaggagggttttgtttttgtttttgtttttaggttgaagattttcttttaatattcagttttttgaaaaaaaatggatctacactgttaactgattgagactccactgtgattcacttgtttacttaaaaacttttcagggatgtctgtaaatttcagtgttaatatgtcatgaaaagtggtgtggattgatctaaggagggaccagaaataatttttgctattccaaatactgaaggaaaaagataattgatttatactatgttttaaaaaaaaaaaaggtattgatgagccccccccccccaggacatttaaccttaaaatttattttaaatgtattcttttattattataagggaaatacagatggctgataaataccaaaaagattcaaaagcagcttaatttaaaaagcacaaagagattctggcttacagtgccccaatctcaatgtttttatagttgctgagctaactaatgtgattattgagtttacagatttaaaaattgtcactgttagagtatctactgtttttatgaagtcaaacttatgctgcctcagaaatccctgggtactgaaatggtaacatggaagtgaagaggtcactttgaaatattggtgagtcacaaagattaaagaaaaggatcagtttgcagatactcagaaaaggttattgaaataattactgaacagcacattttctctctaaaaagtagtttcatatgggttgtatttttaagatcagattatcattttgatatttggtcaaaattttgtaccttaggttacttagagccagatttaacatcatgaacattatgtggctttgtctttactacagatatgtggaactgtaaccaaatatgttgtctctaaaacttgttgattgcaaaatacagttctataaacaaaacccatatgtatatataaatgttaattttgcggaagtctggaaattataactatagcatttaagtttgagtctgtattggacaaataagcaccatgcttttcaaatgatttaaaaattacttttatttgcctctttattttgatggtggttggatttttttttttttaatagtaaaatcactaaacttgtgcaatggtagcatggaaattatctgaggtatattgtatgattgtactttagccagggtggacatagcttaaattataaaaactaaagatgaaagtacaaggaagtataagttatacttatgtaagtataaattcatgctgcctacttctaagagaaatttcattcttcataaccacataacattataatgccactgattcatacgggatttacattaattctatgggggaggacactagaattattagtgttcattttcatctaagatctttattctctaacgttcttggtcctattgaaacattgcagtatgcaaaactactgcaatgttaaacccaagagaaaagccattatcatgtgtatgctggtcatcatgatcagtgtggtacaatttttaaaaataaactatcatgcccttcatgccattatttgtctttatttctatgatttataatcctgatatgtgatgtgtttgtaacacagggtgtgcacttgagcctggttttactgtttttattagacagagttgtttatatgctgtaactgtaacgcagcgagactggttctacagccatgtgtcgtaatcttgttccccgtccaagctgttgtatctgaaggtacccagtttgcacccaggatgagggaacgcattcaaaagtgaaatgtaaagccagtgcacgaatattatagtaattgagattttcccaggcttcactgatacagttgttttgcatttattcacaataatacagcagattcttaaatgccgatttttaattgtcttaaattttgctgctgttctcataattaaggacttgaaaaatgttttagtctgtcaagtatgtaaagtttgtgtaaaaacttttaaatgtcattcttaagttcattgccatagccattttccatttatgtcttcattttccaaaaatcaaatgccatgtctgatacctttaagtccataagcattcaattttctcatttccaccttcatctttggttaacagaataagtaaaacagggtattatttatttgtagtctagaaatgttgaatattgttttatttccttcaaaatgttatgattagtgcagatcagccatgtttatctttttaaaaaataaacaggttgctttatttctt

SEQ ID NO: 184981 - DNA, 6535 bp, Homo sapiens
  Payload ID: 16419
  Gene Symbol: SNX19
  Gene Name: sorting nexin 19
  Uniprot ID: Q92543
  ENST ID: ENST00000265909
  CDS Start-End: 571-3549
atgcctcgctcccgtcgacgtcgacccggaagctgtcgccggcggccggccggcggtcagccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgtgtaagtgtccgtgggccccagggccttgcagcgcccgccccgaggccccgaagaggccttccgcctggggcagtgtgaaggccacagagttttcctccaaagccacacctcagctggaaggggcgagttggagggctctgttagtggtagccatggggagacgcggagctgcagctgtcgctttgcagtgcctgtaggactttgagggcctggagccccggttccctgaacagcacccagatcgccccatatctgagacacagttcatgccccccttccctaactctgaagtaaaatcttgagggctgtcatctggggaagccaccttgtccgttcagccatgaagacagaaacagtgccaccgttccaggaaactccagctggatcgagctgtcacctcaataacctgttgagtagccggaagctgatggctgtgggggtcttgcttggctggctcctggtcatacaccttctggtcaacgtgtggctgctgtgccttctgtcggcattgctagtggtgctgggaggatggctgggctccagcctcgctggagtggcttcaggtcgactgcatctggaacgcttcatcccgttggccacctgtcctccatgccctgaggcagaaaggcagctggaacgggagatcaaccgcaccatccagatgattattcgagattttgtgttatcttggtaccgttccgtgagccaggagccagcctttgaggaagaaatggaggcagccatgaaagggttggtccaggagcttcggagaaggatgagcgtgatggacagtcatgctgttgcccagagtgttctgactctctgcggttgtcacctgcagagctacattcaggcaaaggaggccactgcagggaagaatggtccagttgagccttcccacctctgggaggcttactgccgggcgactgccccacatcctgctgtgcacagccccagtgctgaagtcacctatacgcgtggcgttgtgaatttgttgcttcaagggctggtgcccaagccccacttggagactcgtaccggacgccatgtagtggtcgaactcatcacatgcaatgtaatcttaccactgatcagcaggctgtcagatcctgactggatccaccttgtactcgtgggtatcttttccaaggccagagatccagcaccctgcccagccagtgcccccgaacagccctcagtgccgacatctctgccactgattgctgaggtagagcagcttccagaagggagagcttctccagtagcagccccagtattcctaagttacagtgagccagagggttctgcaggcccctctccagaggttgaagaaggccacgaagctgtagagggagatttgggtgggatgtgtgaagaaagaaaagtaggaaacaactcatctcatttcctacagccaaatgttcgaggtcccctgttcttatgtgaagactcagagctggagtctccgctgtctgaactgggcaaagaaaccatcatgctcatgactccaggcagctttctctctgacaggattcaggatgccctgtgtgccctagagagttcccaggctctggaacccaaagatggtgaggcatctgaaggagcagaggctgaggagggtccagggacagaaacagagacaggcctgccggtctccacactgaattcctgcccagagatccatattgacacagcagacaaggagatagaacaaggagatgttaccgcctctgttacagctttgctggaggggccagaaaagacctgcccctcacggccgtcatgcttagagaaggatctcaccaatgatgtgagctcccttgatcctactctgccaccagttctgctttcctcctctccacctggtcctctcagctcagccaccttcagctttgagcccctaagcagtcccgatggtccagttatcatccagaaccttcgtatcactggcaccattacagcccgagagcacagtggcactggattccacccatacacactctatactgtgaagtacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccattgggaaacatggacagtgacagagtagaagcccgtaagagcctcctagaatcattcctaaagcaactctgtgccattccggagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtctaggctgaggttctcatccagtaaaatttctccagcactaagtgtgactgaagcacaagacaagattctttattgtctccaggaaggcaatgtggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggaacagagacagagttagctgacacagccctggatctgctcctcttgctactaacagaacagtggaaatggctatgtaccgaaaacatgcaaaagtttcttcgtcttatctttgggaccctagttcaaaggtggctagaggtgcaggtagctaatttaacaagtccacagcgctgggtgcagtacctcctgcttcttcaggagtccatctggcctggtggagttttgcctaagtttccacggcccgtaaggacccaagagcagaaactggctgctgagaaacaggctttgcagagcctgatgggagtcctcccagatctcgtagtagaaattcttggggtgaacaaatgccggctgagctggggtctagtcctggagtcactacaacaacccctcatcaacaggcatttgatttactgccttggggacatcatcctggaattcttggatctcagtgcctctgttgaggagtctgctgctaccacctctgcctcagataccccaggcaactctaagaggatgggtgtctcctcttagctggttattcacgccttcttcccaggtcagggaagtagagttactcggccaccagagaccagtcaggaagcccgtgccctcttcaagtaggctacagctaagaaggcctaggttctcggtggctcacttctctcccacttctgctccatttgtagcaggtgacaggggtctgtgtgtcccagttgtatgcacgtttatttccctgttccttttgtgatgttgggattgttgctggtgagtagatcctgtttcctttgggaaaagaagctgtgaggtagaggaatgaaccccttttgcttctccttttgccatcctccctgagattgtttgccagaatcctggccctgtgcacacatgtgcttaatccaccagcacacaagctctagatagaacaggaaaaaaactgtggccagatttccttggaggagaaaacaaccttctcagctctctgttcctacccggaaactaaaaattcattcagggccattctcaaaaaccagactcctgggtctaatctagtttcccaacagttccagaagaagaaggagggaagaaaatttttcaaggaacttcttgctcatgtgttgctgtttcccaacacatcagccttatggaagatgtcatgaggctgcttgcctgggaggctacactttcctttccagaagacttcaaagctgactgccaaagcttctggtaaatccaccccacccttcacaccctttcctgaaaggcatttataccacccattttatttattggctttgctcccaaccccctgccctagagcaattgagtttttgaatttttgaccctctctctgtcttcagcaaaactgcatgacaagctgcatattcagcctcagtttttccaaggagaatggaaagcacttgcctcctgtcttaagaatgcacaaagagtaggactagcaaggctgggggatgaaatctcccttcctaagtctttgacagagaacttttattattctgaacagataagattagcaaacttacaaggaatagcttcttatttcccattccttacggttataatcagtcctttaacaacaccagcatgaaggcaaaggtgttttgtcagactgcaacatctattagaaaggcaaggcaactgggaattgctggagaaggataaatcaggaggaattgctggtagaaaaggctgcagacagtcacagggaagtgctgtatattaaatgcatgtgaatagctggcaaaaagatgtcaaggatgtcactgggagccctttggcttcacactcgcctgttagcgccttgctttcgctgaattaccagagcctaccactcggaggaaggtcttggagttagactgatgagaaggcaatggggtgtcaaaaacaagtgtcaaagttctcttagattctgaagtcggtgatgagcacacaattaaagtggtttgtggaagaaagttgtaaaatctttttacttttttgcccctctggaggcttttaaccctaaattgtgtctgatgtattcgggaggcttaggtgtgcaattcttgcccaaaggcaaggagatgaatgagatgtctcatggcctcttctagccttaaaagttgaccattacagtgactttatggctccaaagttcttgaagcatctccagccctagactttgacaagaaaaggtagctcagcatctctactttccgtgagtacctgcaggagtccagccaatgtattagagctgatcattaagctccttcagtgagggctaagatcctattctcgatgagcatagggggacagccttgttttatgccacttttctctccccatacctaccttcccctcatgtgtacttagccacctgtgttgctttgaatctgctgccagttctggctcaaatgtggcacaaaatcagtacatcagacacaccatgaaatccctgtggctataaattctaaggaatcttttgacacttccagcccaaagaacttatttttatttcgtattatataagagtccccacctctactccacgtaccccaaaaagataagctgtcctcagatcctccttctacccaggagggaaataatggatattgccaagggaacaatcagaactcatctggctttgaaaacgacctgccaagtttggctagcaggttcagacaacaagagagtaacaattggtagagagccacaggtagaaaagatactcccagctgacagggtgataaaaggcagggaagaattgggcctgtgctgatccaggaaggttttattgtttgcttgttttttgtatttactcgtgactaaattttattcatttaagtcagaattttgatatttgaaataagactactttcccttttcttactatctataaaaaagacgaggcagggatgctgtgttctttctgtcaaattctaaatgtgatctttgccattgcttatttgaattcaagaaagctatactttttcatcacatataactcacagtttcatttttgcattgttggattagacttaataaaacctaaatggaaaataaattcctaaatctgagcctaggagcatgtataaattttatttttattattattatacattaagttctagggaacatgtgcacaacatgcaggtttgttgcatatgtatacatgtgccgtgttggtgtgctgcacccgttaactcgtcatttacattaggtatatctcctgatgctatcccttccccctcccccgacctcacaacaggccccagtgtgtgatgttcaccttcctgtgtccaagtgttctcattgttcaattcccacctatgagtgagagcatgtataaattttaaaatcaatacaagctactccaatttccattttggaaatttccagtttacaaggtgattttcttattgttgtaaagaaacacataatgtgagatctaccctcttaagtgtacagtacattatttatttattttgagacggtacattattaactagaagcagcacag

SEQ ID NO: 184982 - DNA, 888 bp, Homo sapiens
  Payload ID: 16419
  Gene Symbol: SNX19
  Gene Name: sorting nexin 19
  ENST ID: ENST00000426933
  CDS Start-End: 35-517
aaattggtgggaaatatactttagctctaatataatgctggccccgaaagatttctcggagaggattcagccttcctgggagggaggctggtgtgcaaatgcagcatcaaggtggctagaggtgcaggtagctaatttaacaagtccacagcgctgggtgcagtacctcctgcttcttcaggagtccatctggcctggtggagttttgcctaagtttccacggcccgtaaggacccaagagcagaaactggctgctgagaaacaggctttgcagagcctgatgggagtcctcccagatctcgtagtagaaattcttggggtgaacaaatgccggctgagctggggtctagtcctggagtcactacaacaacccctcatcaacaggcatttgatttactgccttggggacatcatcctggaattcttggatctcagtgcctctgttgaggagtctgctgctaccacctctgcctcagataccccaggcaactctaagaggatgggtgtctcctcttagctggttattcacgccttcttcccaggtcagggaagtagagttactcggccaccagagaccagtcaggaagcccgtgccctcttcaagtaggctacagctaagaaggcctaggttctcggtggctcacttctctcccacttctgctccatttgtagcaggtgacaggggtctgtgtgtcccagttgtatgcacgtttatttccctgttccttttgtgatgttgggattgttgctggtgagtagatcctgtttcctttgggaaaagaagctgtgaggtagaggaatgaaccccttttgcttctccttttgccatcctccctgagattgtttgccagaatcctggccctgtgcacacatgtgcttaatccacca

SEQ ID NO: 184983 - DNA, 1562 bp, Homo sapiens
  Payload ID: 16419
  Gene Symbol: SNX19
  Gene Name: sorting nexin 19
  ENST ID: ENST00000530356
  CDS Start-End: 415-1533
agccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgtgattcaggatgccctgtgtgccctagagagttcccaggctctggaacccaaagatgtacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccattgggaaacatggacagtgacagagtagaagcccgtaagagcctcctagaatcattcctaaagcaactctgtgccattccggagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtctaggctgaggttctcatccagtaaaatttctccagcactaagtgtgactgaagcacaagacaagattctttattgtctccaggaaggcaatgtggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggaacagagacagagttagctgacacagccctggatctgctcctcttgctactaacagaacagtggaaatggctatgtaccgaaaacatgcaaaagtttcttcgtcttatctttgggaccctagttcaaaggtggctagaggtgcaggtagctaatttaacaagtccacagcgctgggtgcagtacctcctgcttcttcaggagtccatctggcctggtggagttttgcctaagtttccacggcccgtaaggacccaagagcagaaactggctgctgagaaacaggctttgcagagcctgatgggagtcctcccagatctcgtagtagaaattcttggggtgaacaaatgccggctgagctggggtctagtcctggagtcactacaacaacccctcatcaacaggcatttgatttactgccttggggacatcatcctggaattcttggatctcagtgcctctgttgaggagtctgctgctaccacctctgcctcagataccccaggcaactctaagaggatgggtgtctcctcttagctggttattcacgccttcttcccaggtca

SEQ ID NO: 184984 - DNA, 1656 bp, Homo sapiens
  Payload ID: 16419
  Gene Symbol: SNX19
  Gene Name: sorting nexin 19
  ENST ID: ENST00000534726
  CDS Start-End: 494-1192
cactattggttttggcttcttttcccatggcgttgtttgttttactcctcaaggaaaaagatttttatggccatggaaaaaaggaaagatagttggcactaagtcattagctggtattcgaccttcctactggataaggctttgctagatagcctggcccctctccttgtcctgttgcataaagtgctgtgaggcgactgcttgcttggcggtttccatctgtggatgtggatggactgaccctgcacctctgacccctgcagatggtggtgagtgccattgtggacaccttgaagacagcgtttcctcgctctgaaccccagagccccacagaggagctgagtgaggccgagaccgaaagcaagccccagacagaaggtctaggctgaggttctcatccagtaaaatttctccagcactaagtgtgactgaagcacaagacaagattctttattgtctccaggaaggcaatgtggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggaacagagacagagttagctgacacagccctggatctgctcctcttgctactaacagaacagtggaaatggctatgtaccgaaaacatgcaaaagtttcttcgtcttatctttgggaccctagttcaaaggtggctagaggtgcaggtagctaatttaacaagtccacagcgctgggtgcagtacctcctgcttcttcaggagtccatctggcctggtggagttttgcctaagtttccacggcccgtaaggacccaagagcagaaactggctgctgagaaacaggctttgcagagcctgatgggagtcctcccagatctcgtagtagaaattcttggggtgaacaaatgccggctgagctggggtctagtcctggagtcactacaacaacccctcatcaacaggcatttgatttactgccttggggacatcatcctggaattcttggatctcagtgcctctgttgaggagtctgctgctaccacctctgcctcagataccccaggcaactctaagaggatgggtgtctcctcttagctggttattcacgccttcttcccaggtcagggaagtagagttactcggccaccagagaccagtcaggaagcccgtgccctcttcaagtaggctacagctaagaaggcctaggttctcggtggctcacttctctcccacttctgctccatttgtagcaggtgacaggggtctgtgtgtcccagttgtatgcacgtttatttccctgttccttttgtgatgttgggattgttgctggtgagtagatcctgtttcctttgggaaaagaagctgtgaggtagaggaatgaaccccttttgcttctccttttgccatcctccctgagattgtttgccagaatcctggccctgtgcacacatgtgcttaatccaccagcacacaagctctagatagaacaggaaaaaaactgtggccagatttccttggaggagaaaacaaccttctcagctctctgttcctacccggaa

SEQ ID NO: 184985 - DNA, 1506 bp, Homo sapiens
  Payload ID: 16419
  Gene Symbol: SNX19
  Gene Name: sorting nexin 19
  ENST ID: ENST00000528555
  CDS Start-End: 359-1477
agccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgttacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccattgggaaacatggacagtgacagagtagaagcccgtaagagcctcctagaatcattcctaaagcaactctgtgccattccggagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtctaggctgaggttctcatccagtaaaatttctccagcactaagtgtgactgaagcacaagacaagattctttattgtctccaggaaggcaatgtggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggaacagagacagagttagctgacacagccctggatctgctcctcttgctactaacagaacagtggaaatggctatgtaccgaaaacatgcaaaagtttcttcgtcttatctttgggaccctagttcaaaggtggctagaggtgcaggtagctaatttaacaagtccacagcgctgggtgcagtacctcctgcttcttcaggagtccatctggcctggtggagttttgcctaagtttccacggcccgtaaggacccaagagcagaaactggctgctgagaaacaggctttgcagagcctgatgggagtcctcccagatctcgtagtagaaattcttggggtgaacaaatgccggctgagctggggtctagtcctggagtcactacaacaacccctcatcaacaggcatttgatttactgccttggggacatcatcctggaattcttggatctcagtgcctctgttgaggagtctgctgctaccacctctgcctcagataccccaggcaactctaagaggatgggtgtctcctcttagctggttattcacgccttcttcccaggtca

SEQ ID NO: 184986 - DNA, 3096 bp, Homo sapiens
  Payload ID: 16419
  Gene Symbol: SNX19
  Gene Name: sorting nexin 19
  Uniprot ID: Q92543
  ENST ID: ENST00000533214
  CDS Start-End: 511-2922
ccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgtgtaagtgtccgtgggccccagggccttgcagcgcccgccccgaggccccgaagaggccttccgcctggggcagtgtgaaggccacagagttttcctccaaagccacacctcagctggaaggggcgagttggagggctctgttagtggtagccatggggagacgcggagctgcagctgtcgctttgcagtgcctgtaggactttgagggcctggagccccggttccctgaacagcacccagatcgccccatatctgagacacagttcatgccccccttccctaactctgaagtaaaatcttgagggctgtcatctggggaagccaccttgtccgttcagccatgaagacagaaacagtgccaccgttccaggaaactccagctggatcgagctgtcacctcaataacctgttgagtagccggaagctgatggctgtgggggtcttgcttggctggctcctggtcatacaccttctggtcaacgtgtggctgctgtgccttctgtcggcattgctagtggtgctgggaggatggctgggctccagcctcgctggagtggcttcaggtcgactgcatctggaacgcttcatcccgttggccacctgtcctccatgccctgaggcagaaaggcagctggaacgggagatcaaccgcaccatccagatgattattcgagattttgtgttatcttggtaccgttccgtgagccaggagccagcctttgaggaagaaatggaggcagccatgaaagggttggtccaggagcttcggagaaggatgagcgtgatggacagtcatgctgttgcccagagtgttctgactctctgcggttgtcacctgcagagctacattcaggcaaaggaggccactgcagggaagaatggtccagttgagccttcccacctctgggaggcttactgccgggcgactgccccacatcctgctgtgcacagccccagtgctgaagtcacctatacgcgtggcgttgtgaatttgttgcttcaagggctggtgcccaagccccacttggagactcgtaccggacgccatgtagtggtcgaactcatcacatgcaatgtaatcttaccactgatcagcaggctgtcagatcctgactggatccaccttgtactcgtgggtatcttttccaaggccagagatccagcaccctgcccagccagtgcccccgaacagccctcagtgccgacatctctgccactgattgctgaggtagagcagcttccagaagggagagcttctccagtagcagccccagtattcctaagttacagtgagccagagggttctgcaggcccctctccagaggttgaagaaggccacgaagctgtagagggagatttgggtgggatgtgtgaagaaagaaaagtaggaaacaactcatctcatttcctacagccaaatgttcgaggtcccctgttcttatgtgaagactcagagctggagtctccgctgtctgaactgggcaaagaaaccatcatgctcatgactccaggcagctttctctctgacaggattcaggatgccctgtgtgccctagagagttcccaggctctggaacccaaagatggtgaggcatctgaaggagcagaggctgaggagggtccagggacagaaacagagacaggcctgccggtctccacactgaattcctgcccagagatccatattgacacagcagacaaggagatagaacaaggagatgttaccgcctctgttacagctttgctggaggggccagaaaagacctgcccctcacggccgtcatgcttagagaaggatctcaccaatgatgtgagctcccttgatcctactctgccaccagttctgctttcctcctctccacctggtcctctcagctcagccaccttcagctttgagcccctaagcagtcccgatggtccagttatcatccagaaccttcgtatcactggcaccattacagcccgagagcacagtggcactggattccacccatacacactctatactgtgaagtacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccattgggaaacatggacagtgacagagtagaagcccgtaagagcctcctagaatcattcctaaagcaactctgtgccattccggagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtctaggctgaggttctcatccagtaaaatttctccagcactaagtgtgactgaagcacaagacaagattctttattgtctccaggaaggcaatgtgacaaagttactggaaatgcagccaacaaaagccccagaaaaagatcctgaacaacctcccaaaggacgtgtggacagttgcgtgtcagatgcagccgtgccagcccaagaccccagcaacagcgatccagctgagcatgccatgtgttgaactccagtgttggaggtgctgtgttggggcacagagatgagtagtacatagttgccacagcggaatcaagcagcagaacagggcacaaacacaggaagttctaatccagcaggatgagatcatgctgataatattgataactcattaaacttatttttggcatgctttggcata

SEQ ID NO: 184987 - DNA, 2128 bp, Homo sapiens
  Payload ID: 16420
  Gene Symbol: SNX2
  Gene Name: sorting nexin 2
  Uniprot ID: O60749
  ENST ID: ENST00000379516
  CDS Start-End: 109-1668
aggccggccgggggcggggaggctggcgggtcggcgcgggcccagccgtgcgtgctcacgtgacgggtccgcgaggcccagctcgcgcagtcgttcgggtgagcgaagatggcggccgagagggaacctcctccgctgggggacgggaagcccaccgactttgaggatctggaggacggagaggacctgttcaccagcactgtctccaccctagagtcaagtccatcatctccagaaccagctagtcttcctgcagaagatattagtgcaaactccaatggcccaaaacccacagaagttgtattagatgatgacagagaagatctttttgcagaagccacagaagaagtttctttggacagccctgaaagggaacctatcctatcctcggaaccttctcctgcagtcacacctgtcactcctactacactcattgctcctagaattgaatcaaagagtatgtctgctcccgtgatctttgatagatccagggaagagattgaagaagaagcaaatggagacatttttgacatagaaattggtgtatcagatccagaaaaagttggtgatggcatgaatgcctatatggcatatagagtaacaacaaagacatctctttccatgttcagtaagagtgaattttcagtgaaaagaagattcagcgactttcttggtttgcacagcaaattagcaagcaaatatttacatgttggttatattgtgccaccagctccagaaaagagtatagtagggatgaccaaggtcaaagtgggtaaagaagactcatcatccactgagtttgtagaaaaacggagagcagctcttgaaaggtatcttcaaagaacagtaaaacatccaactttactacaggatcctgatttaaggcagttcttggaaagttcagagctgcctagagcagttaatacacaggctctgagtggagcaggaatattgaggatggtgaacaaggctgccgacgctgtcaacaaaatgacaatcaagatgaatgaatcggatgcatggtttgaagaaaagcagcagcaatttgagaatctggatcagcaacttaggaaacttcatgtcagtgttgaagccttggtctgtcatagaaaagaactttcagccaacacagctgcctttgctaaaagtgctgccatgttaggtaattctgaggatcatactgctttatctagagctttgtctcagcttgcagaggttgaggagaagatagaccagttacatcaagaacaagcttttgctgacttttatatgttttcagaactacttagtgactacattcgtcttattgctgcagtgaaaggtgtgtttgaccatcgaatgaagtgctggcagaaatgggaagatgctcaaattactttgctcaaaaaacgtgaagctgaagcaaaaatgatggttgctaacaaaccagataaaatacagcaagctaaaaatgaaataagagagtgggaggcgaaagtgcaacaaggggaaagagattttgaacagatatctaaaacgattcgaaaagaagtgggaagatttgagaaagaacgagtgaaggattttaaaaccgttatcatcaagtacttagaatcactagttcaaacacaacaacagctgataaaatactgggaagcattcctacctgaagccaaagccattgcctagcaataagattgttgccgttaagaagaccttggatgttgttccagttatgctggattccacagtgaaatcatttaaaaccatctaaataaaccactatatattttatgaattacatgtggttttatatacacacacacacacacacacacacacacacacacactctgacattttattacaagctgcatgtcctgaccctctttgaattaagtggactgtggcatgacattctgcaatactttgctgaattgaacactattgtgtcttaaatacttgcactaaatagtgcactgcaagaccagaaaattttacaatattttttctttacaatatgttctgtagtatgtttaccctctttatgaagtgaattaccaatgctttgaataatgttcacttatacattcctgtacagaaattacgattttgtgattacagtaataaaatgatattccttgtgaaa

SEQ ID NO: 184988 - DNA, 2119 bp, Homo sapiens
  Payload ID: 16420
  Gene Symbol: SNX2
  Gene Name: sorting nexin 2
  Uniprot ID: O60749
  ENST ID: ENST00000514949
  CDS Start-End: 804-2012
accctagaggtgagaccgcgtcgctgcgggtgctgcgctgcgtagctgccgcgcgtctcacctttcccctgccccgacttgtccctccccatcccccgtgtttgcaaggaccgtcttggggtgacacctgtgacgcgagccccacctccggtgcctgtcagagggatgtgcttgggctgagcgcagggcctcctcaggagagcagcctgcggcccgcgggtgccgacctaatcctcagaggggccagaaccgaaccgagcattgcagcggcgctttcccagctcagctggccttcctcggtgtctcttgcacgtcctcctcttcaagccggagaagggcttgctctgcatcccagtaaacctccaccgagctcttttgaaggggtgctcgcttttcctttccagagggagggtgtgccgctgccaggggagcgcaatgaagtgagcgctgaggggccgagggtctgtggggaacgaatgggtgcactttcccaggaatggcccttcacggactgctggttcctcttgagggagctgcttctgatttggactgttaaatagtcaagtccatcatctccagaaccagctagtcttcctgcagaagatattagtgcaaactccaatggcccaaaacccacagaagttgtattagatgatgacagagaagatctttttgcagaagccacagaagaagtttctttggacagccctgaaagggaacctatcctatcctcggaaccttctcctgcagtcacacctgtcactcctactacactcattgctcctagaattgaatcaaagagtatgtctgctcccgtgatctttgatagatccagggaagagattgaagaagaagcaaatggagacatttttgacatagaaattggtgtatcagatccagaaaaagttggtgatggcatgaatgcctatatggcatatagagtaacaacaaagacatctctttccatgttcagtaagagtgaattttcagtgaaaagaagattcagcgactttcttggtttgcacagcaaattagcaagcaaatatttacatgttggttatattgtgccaccagctccagaaaagagtatagtagggatgaccaaggtcaaagtgggtaaagaagactcatcatccactgagtttgtagaaaaacggagagcagctcttgaaaggtatcttcaaagaacagtaaaacatccaactttactacaggatcctgatttaaggcagttcttggaaagttcagagctgcctagagcagttaatacacaggctctgagtggagcaggaatattgaggatggtgaacaaggctgccgacgctgtcaacaaaatgacaatcaagatgaatgaatcggatgcatggtttgaagaaaagcagcagcaatttgagaatctggatcagcaacttaggaaacttcatgtcagtgttgaagccttggtctgtcatagaaaagaactttcagccaacacagctgcctttgctaaaagtgctgccatgttaggtaattctgaggatcatactgctttatctagagctttgtctcagcttgcagaggttgaggagaagatagaccagttacatcaagaacaagcttttgctgacttttatatgttttcagaactacttagtgactacattcgtcttattgctgcagtgaaaggtgtgtttgaccatcgaatgaagtgctggcagaaatgggaagatgctcaaattactttgctcaaaaaacgtgaagctgaagcaaaaatgatggttgctaacaaaccagataaaatacagcaagctaaaaatgaaataagagagtgggaggcgaaagtgcaacaaggggaaagagattttgaacagatatctaaaacgattcgaaaagaagtgggaagatttgagaaagaacgagtgaaggattttaaaaccgttatcatcaagtacttagaatcactagttcaaacacaacaacagctgataaaatactgggaagcattcctacctgaagccaaagccattgcctagcaataagattgttgccgttaagaagaccttggatgttgttccagttatgctggattccacagtgaaatcatttaaaaccatctaaataaaccactatatattttatg

SEQ ID NO: 184989 - DNA, 819 bp, Homo sapiens
  Payload ID: 16420
  Gene Symbol: SNX2
  Gene Name: sorting nexin 2
  ENST ID: ENST00000505934
  CDS Start-End: 23-819
gcagtcgttcgggtgagcgaagatggcggccgagagggaacctcctccgctgggggacgggaagcccaccgactttgaggatctggaggacggagaggacctgttcaccagcactgtctccaccctagagtcaagtccatcatctccagaaccagctagtcttcctgcagaagatattagtgcaaactccaatggcccaaaacccacagaagttgtattagatgatgacagagaagatctttttgcagccacagaagaagtttctttggacagccctgaaagggaacctatcctatcctcggaaccttctcctgcagtcacacctgtcactcctactacactcattgctcctagaattgaatcaaagagtatgtctgctcccgtgatctttgatagatccagggaagagattgaagaagaagcaaatggagacatttttgacatagaaattggtgtatcagatccagaaaaagttggtgatggcatgaatgcctatatggcatatagagtaacaacaaagacatctctttccatgttcagtaagagtgaattttcagtgaaaagaagattcagcgactttcttggtttgcacagcaaattagcaagcaaatatttacatgttggttatattgtgccaccagctccagaaaagagtatagtagggatgaccaaggtcaaagtgggtaaagaagactcatcatccactgagtttgtagaaaaacggagagcagctcttgaaaggtatcttcaaagaacagtaaaacatccaactttactacaggatcctgatttaaggcagttcttggaaagttcagaggt

SEQ ID NO: 184990 - DNA, 763 bp, Homo sapiens
  Payload ID: 16420
  Gene Symbol: SNX2
  Gene Name: sorting nexin 2
  ENST ID: ENST00000512394
  CDS Start-End: 26-256
cgcgcagtcgttcgggtgagcgaagatggcggccgagagggaacctcctccgctgggggacgggaagcccaccgactttgaggatctggaggacggagaggacctgttcaccagcactgtctccaccctagagtcaagtccatcatctccagaaccagctagtcttcctgcagaagatattagtgcaaactccaatggcccaaaacccacagaagttgtattagatgatgacagagaagatctttttgcagattgaagaagaagcaaatggagacatttttgacatagaaattggtgtatcagatccagaaaaagttggtgatggcatgaatgcctatatggcatatagagtaacaacaaagacatctctttccatgttcagtaagagtgaattttcagtgaaaagaagattcagcgactttcttggtttgcacagcaaattagcaagcaaatatttacatgttggttatattgtgccaccagctccagaaaagagtatagtagggatgaccaaggtcaaagtgggtaaagaagactcatcatccactgagtttgtagaaaaacggagagcagctcttgaaaggtatcttcaaagaacagtaaaacatccaactttactacaggatcctgatttaaggcagttcttggaaagttcagagctgcctagagcagttaatacacaggctctgagtggagcaggaatattgaggatggtgaacaaggctgccgacgctgtcaacaaaatgacaatcaagatgaatga

SEQ ID NO: 184991 - DNA, 3304 bp, Homo sapiens
  Payload ID: 16421
  Gene Symbol: SNX20
  Gene Name: sorting nexin 20
  Uniprot ID: Q7Z614
  ENST ID: ENST00000300590
  CDS Start-End: 174-563
gggcgatcagaagcaggtcacacagcctgtttcctgttttcaaacggggaacttagaaagtggcagcccctcggcttgtcgccggagctgagaaccaagagctcgaaggggccatatgacactcctcccggacccctggacacacacagccctggagactggagccttggagcatggcaagtccagagcaccctgggagccctggctgcatgggacccataacccagtgcacggcaaggacccagcaggaagcaccagccactggccccgacctcccgcacccaggacctgacgggcacttagacacacacagtggcctgagctccaactccagcatgaccacgcgggagcttcagcagtactggcagaaccagaaatgccgctggaagcacgtcaaactgctctttgagatcgcttcagctcgcatcgaggagagaaaagtctctaagtttgtgatggggaaatcaaggcctggagagatgacttatccagggtcacgtggcgagacagggacagcaccagaaccagacccgagatgtccacgtcaaagtgacatgctctgagaggcagcacacacagaataaccctgcatccaaattccaggaagctcttaggggtcatccagctgggcctaggggtgcagggtcagtgctgaggcctgggcagggccgctagcctccctgagctttctggcttcaggctgggaggcacagttcagggtggactgtgaccccttggcctagaatgcccttagctctgctctctagtggctgtccccatagctggaactctgttttggagtggcaaaaccagttccacctgctggtaggggtaggttggctcccaacacatccccagcaggcctctcttgggctcaaaagccaagctgtgcccagccacgtctccaaatgcttcctggcccccatgcagcaactgcatttagctgccttcccagaatttcctgcatgctcacacagcccttccctctggggcccaacaatgccacagcctgttctatcaatcaccagctgttttcctttgagcagtctccttttacttatgcacatttacttgaaaaagaaacttcctattactatcctaaatggaaactcagaatcacttgctataattagaaagtagctacaaaaataaacacaatgaaaccgatcactgttattacaccctaacccgcttttacctgagacaggccctgagcctgaggccgctggtagacttttgttaaaagagagagagacagagacagagaaataagcattagagacctgcaatcaccaagctgagacttctctttgatttactcagaaggactggaaaatgttgtcctgcaaaaggaggtaagtttctcaccacgtagcgctgatcatcccgtgttgcccgtgcgttgctgcagaccatctggggtcttgcccaagcaccctggagactttgctccctggtttcctggtcaccaactcgagtgttcagccctgtgtgctctccagctcctaagtcgtgggcctggtttcagctttgattgcccactcttggctttcaacccgtaggctccggctcctgacgccacaccctgatatcaagaccctcagatggagcgagcgttctgggctggtcgaagcctgaagccgcagtatgtccttgagtgggtccccccctacccatctagctgttgcccccatggtaagatcaagaaaatgccctcccctccaaaagtccccacgccgagccctcatctgtcagctcccaggctcggccccctcactagctccaggctgggaggcacagttcagggcagactgtggcccctcagcatagcatggacttagctctgctctctagtggctgtccccatagctagaactctgttttggagcagcaaaactagttccacctgctggtagggctaagttgactcccaacatgtccccagcgtgttggtgttgggaaccttgatctagctgctcgttttctcagtaaccaaagatccctggcactcctacgatgtctcaggccttatctagagctggggatacagcagtgaccaggacagaactggtccctgcctcacggaagtgaagtgtcaggaggccactcccaaagcaaatggaagctgggacagaatgatgtcctcagccaggtggtcagggaaggcttctcagagggggcgctgttcaaagaatcacagagcatacaaaggagctggccctgggagcacagagaggggagaattttaggcaaagaggtagcaggagcacagccctgaggcaggaaactacccccccaccaccctcggcatcctcagttctggtttgcacccagaaagggggtaggtccaggacacacccggactgatgtgtcacactggctgtgccagctgagagagtgggctccaggcaccactaacagagaagccttgcaaggcaggtccatgcaccgcccgcctccagttaccactcattgcaaaggaaatgagctgggagcctgtgtgtgggccgtgcagacccttttggttacaagccacaaaaacccaggttaatctgatgaggaaggaatttattatctgtaaagtccaggagcaggctagctttacaccaagcaggatccaaggacccacacttgtcacctcatatctctctctctctcccactttcgctttctctgtctcttcttagttctgctttcctccactgtgccttcgctctcagagagagctctcccctggcagtgacaagatggctgcagcagctccagcaacctcagaggactcccccatccagggtccttgtgagctcctcatctgtaggatgtgcagtaaacactcacgtgtcctttcctgaggagcccagtggctggggtgggggctgaggggcagcccctatgccctcacagtgcagcaaccttggttagctcacccatcagggcagacttgggcagaaatcatgtcttggcatattgttttgtaatctgctttttaaattgtcactatatattatgagcatttccctataatatacaatattcttccacattatgtttaatggtttcattgtattctaatgcatattctatagttattttaaccaccccacaatgttgcaaaatgtccttatttgggacaacactgctgcaaacactttgacccatatgtcctttttgtgtgcactcttatggcaacttctaacggtggcatttctgaatcatagacacttttttgacttctacatattttatttttttagttgacaaaaactgtatttatgaatcataaacacttaatgattttgctatt

SEQ ID NO: 184992 - DNA, 2904 bp, Homo sapiens
  Payload ID: 16421
  Gene Symbol: SNX20
  Gene Name: sorting nexin 20
  Uniprot ID: Q7Z614
  ENST ID: ENST00000330943
  CDS Start-End: 173-1123
ggcgatcagaagcaggtcacacagcctgtttcctgttttcaaacggggaacttagaaagtggcagcccctcggcttgtcgccggagctgagaaccaagagctcgaaggggccatatgacactcctcccggacccctggacacacacagccctggagactggagccttggagcatggcaagtccagagcaccctgggagccctggctgcatgggacccataacccagtgcacggcaaggacccagcaggaagcaccagccactggccccgacctcccgcacccaggacctgacgggcacttagacacacacagtggcctgagctccaactccagcatgaccacgcgggagcttcagcagtactggcagaaccagaaatgccgctggaagcacgtcaaactgctctttgagatcgcttcagctcgcatcgaggagagaaaagtctctaagtttgtggtgtaccaaatcatcgtcatccagactgggagctttgacaacaacaaggccgtcctggaacggcgctattccgacttcgcgaagctccagaaagcgctgctgaagacgttcagggaggagatcgaagacgtggagtttcccaggaagcacctgactgggaacttcgctgaggagatgatctgtgagcgtcggcgcgccctgcaggagtacctgggcctgctctacgccatccgctgcgtgcgccgctcccgggagttcctggacttcctcacgcggccggagctgcgcgaggctttcggctgcctgcgggccggccagtacccgcgcgccctggagctgctgctgcgcgtgctgccgctgcaggagaagctcaccgcccactgccctgcggccgccgtcccggccctgtgcgccgtgctgctgtgccaccgcgacctcgaccgccccgccgaggccttcgcggccggagagagggccctgcagcgcctgcaggcccgggagggccatcgctactatgcgcctctgctggacgccatggtccgcctggcctacgcgctgggcaaggacttcgtgactctgcaggagaggctggaggagagccagctccggaggcccacgccccgaggcatcaccctgaaggagctcactgtgcgagaatacctgcactgagccggcctgggaccccgcagggacgctggagatttggggtcaccatggctcacagtgggctgtttggggttctttttttttatttttccttttcttttttgttatttgagacagtcttgctctgtcacccagactgaagtgcagtggctcaattatgtctcactgcagcctcaaactcctgggcacaagcaatcctcccacctcagcctcccaagtagctgggattacaggtgcacaccaccacaccaggctaatttttaattttttagtagagacagggtctctctgttgcccaggctggtctctaacttctgaccttaaatgatcttcctgcctcagcttcccaaaacactggggttacaagtgtgagccaccacccctggcctggggttcatttttaatgggaaaagccactgggggctctaactcgctgggtgactttggacaagcccctcctctggtcctcaatttctccatctgtattggacagaggtgctcctgggaccccttggaagcctctgcttgtgtcccacgtcctcttgatgccagggccacttcatctccaaaacacaaaaccaactgccaaaaccgtccagagcagtgtccaccccaccagtgtctttgtgggaagctggagaagaagtttacctcacacattctagacaaaacttagtccatttccttgaagacagttctctccagctgctccaaggcttttctctctgttccttccaccttggaattgctttaaaatatttccatccattatcctaatactatcttagtattctagcccttcccccttaccatgtagacctgacaaagcaaaacaaaagctcacctattgccctcaagaacagcctctacacacacacacacacacacacacacacacacacacacacacacggtgggagttgtatgccatccttttgaagggtgggaggaccctggaccagaaagcaataatggcataagattctgtgataccaggcatttttggcaagggaagttgccaacaatttttctggctgggatggcatagcacattgtctaggggtggattttcattcataaggcagctgttccctgaatggcttccctgggttatgtagaaacagcctggggaggaggtgatacaacatacttaatggggcctctgggcagaaaacagactgaatcctcaacactgccccttttgagggtctgtgatcctggaacttctctgatggactgggatgcccttaactgaggtctgctgtctggaaaggacaccacaggcccagaatgaaggggcatctggaccaatgacctagattcaacacagggcttggagctggtggtacaggctggttttggcccaatgtgtgttggaggctggaagcccctgaagacctaaactgcctggatgagcttattagggtgaattaatgagtctgtaatttgggaaccttaatgtgagacaccacttaaggagaggaacttggcccagcaagtgatcactctagaagtggacagctatgcactagactgcaccagaatctgttcaacagcgacaccttgtggtaaaaactgtagacgccccatcaggctggatgggaaactagaaacagactgtctcatctttggacagatatccctcaaatctcccaatctactccagggaaaagacacttcaagtgagagatattggacttcttgaaaatctaggcctatggaaaattaaagtgttaaatggaaaaattaaagagctatgagtctatttgtaatgatgaaacaga

SEQ ID NO: 184993 - DNA, 2156 bp, Homo sapiens
  Payload ID: 16421
  Gene Symbol: SNX20
  Gene Name: sorting nexin 20
  Uniprot ID: Q7Z614
  ENST ID: ENST00000423026
  CDS Start-End: 133-441
aaacggggaacttagaaagtggcagcccctcggcttgtcgccggagctgagaaccaagagctcgaaggggccatatgacactcctcccggacccctggacacacacagccctggagactggagccttggagcatggcaagtccagagcaccctgggagccctggctgcatgggacccataacccagtgcacggcaaggacccagcaggaagcaccagccactggccccgacctcccgcacccaggacctgacgggcacttagacacacacagtggcctgagctccaactccagcatgaccacgcgggagcttcagcagtactggcagaaccagaaatgccgctggaagcacgtcaaactgctctttgagatcgcttcagctcgcatcgaggagagaaaagtctctaagtttgtggctccggctcctgacgccacaccctgatatcaagaccctcagatggagcgagcgttctgggctggtcgaagcctgaagccgcagtatgtccttgagtgggtccccccctacccatctagctgttgcccccatggtaagatcaagaaaatgccctcccctccaaaagtccccacgccgagccctcatctgtcagctcccaggctcggccccctcactagctccaggctgggaggcacagttcagggcagactgtggcccctcagcatagcatggacttagctctgctctctagtggctgtccccatagctagaactctgttttggagcagcaaaactagttccacctgctggtagggctaagttgactcccaacatgtccccagcgtgttggtgttgggaaccttgatctagctgctcgttttctcagtaaccaaagatccctggcactcctacgatgtctcaggccttatctagagctggggatacagcagtgaccaggacagaactggtccctgcctcacggaagtgaagtgtcaggaggccactcccaaagcaaatggaagctgggacagaatgatgtcctcagccaggtggtcagggaaggcttctcagagggggcgctgttcaaagaatcacagagcatacaaaggagctggccctgggagcacagagaggggagaattttaggcaaagaggtagcaggagcacagccctgaggcaggaaactacccccccaccaccctcggcatcctcagttctggtttgcacccagaaagggggtaggtccaggacacacccggactgatgtgtcacactggctgtgccagctgagagagtgggctccaggcaccactaacagagaagccttgcaaggcaggtccatgcaccgcccgcctccagttaccactcattgcaaaggaaatgagctgggagcctgtgtgtgggccgtgcagacccttttggttacaagccacaaaaacccaggttaatctgatgaggaaggaatttattatctgtaaagtccaggagcaggctagctttacaccaagcaggatccaaggacccacacttgtcacctcatatctctctctctctcccactttcgctttctctgtctcttcttagttctgctttcctccactgtgccttcgctctcagagagagctctcccctggcagtgacaagatggctgcagcagctccagcaacctcagaggactcccccatccagggtccttgtgagctcctcatctgtaggatgtgcagtaaacactcacgtgtcctttcctgaggagcccagtggctggggtgggggctgaggggcagcccctatgccctcacagtgcagcaaccttggttagctcacccatcagggcagacttgggcagaaatcatgtcttggcatattgttttgtaatctgctttttaaattgtcactatatattatgagcatttccctataatatacaatattcttccacattatgtttaatggtttcattgtattctaatgcatattctatagttattttaaccaccccacaatgttgcaaaatgtccttatttgggacaacactgctgcaaacactttgacccatatgtcctttttgtgtgcactcttatggcaacttctaacggtggcatttctgaatcatagacacttttttgacttctacatattttatttttttagttgacaaaaactgtatttatgaatcataaacacttaatgattttgctatt

SEQ ID NO: 184994 - DNA, 2003 bp, Homo sapiens
  Payload ID: 16421
  Gene Symbol: SNX20
  Gene Name: sorting nexin 20
  Uniprot ID: Q7Z614
  ENST ID: ENST00000568993
  CDS Start-End: 123-512
cttagaaagtggcagcccctcggcttgtcgccggagctgagaaccaagagctcgaaggggccatatgacactcctcccggacccctggacacacacagccctggagactggagccttggagcatggcaagtccagagcaccctgggagccctggctgcatgggacccataacccagtgcacggcaaggacccagcaggaagcaccagccactggccccgacctcccgcacccaggacctgacgggcacttagacacacacagtggcctgagctccaactccagcatgaccacgcgggagcttcagcagtactggcagaaccagaaatgccgctggaagcacgtcaaactgctctttgagatcgcttcagctcgcatcgaggagagaaaagtctctaagtttgtgatggggaaatcaaggcctggagagatgacttatccagggtcacgtggcgagacagggacagcaccagaaccagacccgagatgtccacgtcaaagtgacatgctctgagaggcagcacacacagaataaccctgcatccaaattccaggaagctcttaggggtcatccagctgggcctaggggtgcagggtcagtgctgaggcctgggcagggccgctagcctccctgagctttctggcttcaggctgggaggcacagttcagggtggactgtgaccccttggcctagaatgcccttagctctgctctctagtggctgtccccatagctggaactctgttttggagtggcaaaaccagttccacctgctggtaggggtaggttggctcccaacacatccccagcaggcctctcttgggctcaaaagccaagctgtgcccagccacgtctccaaatgcttcctggcccccatgcagcaactgcatttagctgccttcccagaatttcctgcatgctcacacagcccttccctctggggcccaacaatgccacagcctgttctatcaatcaccagctgttttcctttgagcagtctccttttacttatgcacatttacttgaaaaagaaacttcctattactatcctaaatggaaactcagaatcacttgctataattagaaagtagctacaaaaataaacacaatgaaaccgatcactgttattacaccctaacccgcttttacctgagacaggccctgagcctgaggccgctggtagacttttgttaaaagagagagagacagagacagagaaataagcattagagacctgcaatcaccaagctgagacttctctttgatttactcagaaggactggaaaatgttgtcctgcaaaaggaggtaagtttctcaccacgtagcgctgatcatcccgtgttgcccgtgcgttgctgcagaccatctggggtcttgcccaagcaccctggagactttgctccctggtttcctggtcaccaactcgagtgttcagccctgtgtgctctccagctcctaagtcgtgggcctggtttcagctttgattgcccactcttggctttcaacccgtaggctccggctcctgacgccacaccctgatatcaagaccctcagatggagcgagcgttctgggctggtcgaagcctgaagccgcagtatgtccttgagtgggtccccccctacccatctagctgttgcccccatgttctgctttcctccactgtgccttcgctctcagagagagctctcccctggcagtgacaagatggctgcagcagctccagcaacctcagaggactcccccatccagggtccttgtgagctcctcatctgtaggatgtgcagtaaacactcacgtgtcctttcctgaggagcccagtggctggggtgggggctgaggggcagcccctatgccctcacagtgcagcaaccttggttagctcacccatcagggcagacttgggcagaaatcatgtcttggcatattgttttgtaatctgctttttaaattgtcactatatattatgagcatttccctataatatacaatattcttccacatta

SEQ ID NO: 184995 - DNA, 557 bp, Homo sapiens
  Payload ID: 16421
  Gene Symbol: SNX20
  Gene Name: sorting nexin 20
  ENST ID: ENST00000610485
  CDS Start-End: 27-485
agccctggagactggagccttggagcatggcaagtccagagcaccctgggagccctggctgcatgggacccataacccagtgcacggcaaggacccagcaggaagcaccagccactggccccgacctcccgcacccaggacctgacgggcacttagacacacacagtggcctgagctccaactccagcatgaccacgcgggagcttcagcagtactggcagaaccagaaatgccgctggaagcacgtcaaactgctctttgagatcgcttcagctcgcatcgaggagagaaaagtctctaagtttgtggtgtaccaaatcatcgtcatccagactgggagctttgacaacaacaaggccgtcctggaacggcgctattccgacttcgcgaagctccaggagaggctggaggagagccagctccggaggcccacgccccgaggcatcaccctgaaggagctcactgtgcgagaatacctgcactgagccggcctgggaccccgcagggacgctggagatttggggtcaccatggctcacagtgggctgtttggggttc

SEQ ID NO: 184996 - DNA, 3614 bp, Homo sapiens
  Payload ID: 16422
  Gene Symbol: SNX22
  Gene Name: sorting nexin 22
  Uniprot ID: Q96L94
  ENST ID: ENST00000325881
  CDS Start-End: 60-641
gctccgggagagttagggctccgagccgagcgcgcggagcagctggggccggggcgcggatgctggaagttcacatcccgtcggtggggcccgaggccgaggggcccaggcagagcccggagaaaagccacatggtgttccgagtggaggtgctgtgcagcgggcgcagacacacggtgccaaggcgctacagcgagttccacgcgctgcacaagcggatcaagaagctgtacaaagtgcccgacttcccctcgaaacgcctgcccaactggaggaccagagggttggaacagcgccggcagggcttggaggcttacatccagggcatcctgtacctgaaccaggaggtgcccaaggagttactggaattcctgagacttcggcacttccccacagaccccaaggctagcaactggggcaccctgagggagttcctgcctggcgacagcagctcccagcagcaccagcggcctgtcctgagcttccatgtggatccctatgtttgcaacccctccccagagtcgctgcccaacgtggtggtgaatggtgtgctccagggcctctacagcttcagcatcagcccagataaagcccagccaaaggcggcctgtcaccctgctcctctgccaccgatgccctgatcagtccagaggcctttggctgcctcctaagaaagtcatgtgcctctgtcctatgaactccatataaggctgggtcctcctttggcctggacccaggacttaattacccagtgcccagttgtgccacattcccactcaaggctcagaacttggctcgcattggtagctggaggtggtagaatttgtatgctcttagagcccaacagccaaggcagggtcaagaagataagtaataaaagaggaagtcagccaggcgcggtggctcatgcctgtaatcccagcactttgggaggccaagatgggtggatcacctgaagtcaggagttcgagaccagcctgaccaccatggagaaaccccgtctctactaaaaatacaaaattagccgggcattgtggtggtgcatgcctgtaatcccagctactcgggaagctgaggtaggagaatctcttttttttttttttttttttttttgagacggagtttcactcttgttgcccaggctggaatgcaatggcacgatctcggctcacggcaacccccgcttcccgggttcaagcaattctcctgcctcagcctctcgagtagctgggattacaggcatccgccaccatgcccggctaatttttgtatttttaatagagatgggtttcaccacgttggccaggctggtcttgtactcctgacgtcaggtgatccacccgcctcggcttcccaaagtgctgggattacgggcgtgagccaccgtgctcggcccaaggcaggagaatctcttgaagccaggaggcggaagttgtggtgagccgagatcgcgccactgcactccagcctgggcaacaagagtgaaactccgtctcaaaataaataaataataaaggaagaagtcagctgggtgcagaggctcatgcctgtaatcccaatactttaggaggccaaggcaggaggatgcttgggtctggaagtttgagaccagccagcgcaacatagtgagacctgtctctaccaaaaaaaaaaaaaaaaaaaaaaaatcaatttagaggtaggctatgaaaaagtacagatacatcccttaacatagactggagggtggtggcaaggggagcaaatgtggaggcccagtagctggcaaagtttagaagcagggggcaaaagctcctgcctgacttttcctgggtagctcctgggtcaaaatttcaggcaggatcccagggaaggggcaggcacccattgccacaggagagttgcaggcatgttgggatgtaggcctaggggaggtgctgcaggctcaagaaccaggcccacacattatatattaaaaaaaaaaaaacccacatttttttttattggtcagtgttggtaggagtttgttacaaaagtgagtccatgggcctgtggaatgtgaggggagtgggtccgctccaccagatgccagcaccggggccagtgcagctcagagccctgtggcggactacagggcctgcacagacggtcactcaaagaaagatgtccctgtgccctactccttggcgatggcaaagggcttctccacctcgatcttgccgcagtctgcgatgatcacatccttcaggggtttatcccggctgtctgtcttggtgctctccaccttccgcaccacctcctggaaaagaaaggtggaagcaggagggcatggtggatcaggaggtccaccgctcaggagaaaggccccagcgtatggctcaggagggctaagacccacaagtgatcaacagcacacaaaactggaggcaccaaaattctaacagactcctggccagagcagggagaatgcagatttgacgagggggtacaggaattttgttcctttgaagtaagacccaggttgggccaagggtgaggaggaggaagagggtgaccagggcatgtggcttctcagggacattgcgttcagctgcactctgtatacctcaggggtgggaccagcacgtcactgagtgaaggaggggagggaggctctggcagttgtgcagccttcctggctgggctctgagggggctggaagaatttagaaccttggaggcatggaggtacagggtttattctggacaggagcactgggctgcatctgtgggttgggtccttttgggaaagggatggacacatggagctcctgccctggggtctgtgttgaatccccggtgaggattgcccagtagtagcccttgcttccacaactcaccatgccctctagaactttgccaaacaccacatgcttgccatctagccaggctgtcttgactgtcgtgatgaagaactgggagccgttggtgtctttgcctgcgttggccatgctcacccagccaggcccgtagtgcttcagtttgaagttctcatcggggaagcgctcaccgtagatgctctttcctgggaaaaaagacagagcaggtcaggggcgctggattgcgccaaaccaagcagacattcggggccaggactgagggggcttaacctgtcctctgtgccaggctaggctggagtggactacaaggacataaaagcagcgtccttcctatcttctggcctcagagccaagccatgctgactgaggccaagtggggcatcaggccaggctgatgtggtgaacagctcacagaaggattactttgagaagatagttttgtggcttttaaataaggcgcatgttatcagctccccttagctatggcccaggcctgccacggagggactttggtggagggaagtgccgtgcaggatgcaggggagtcaacagggtcggaactctccagaaaaggaggactgctgtggctgaccagcctgttttcctatgagcacaaaagacacaggcatagctgcagaggagaaagcagccagagatgtgtggggaggggcagaaaagaggggctgccccttggattctggagagtcaaagcctcttaacaaggaatgaacaggaataaaagacagctgtgagtgtg

SEQ ID NO: 184997 - DNA, 1353 bp, Homo sapiens
  Payload ID: 16422
  Gene Symbol: SNX22
  Gene Name: sorting nexin 22
  Uniprot ID: Q96L94
  ENST ID: ENST00000558466
  CDS Start-End: 38-400
gagccgagcgcgcggagcagctggggccggggcgcggatgctggaagttcacatcccgtcggtggggcccgaggccgaggggcccaggcagagcccggagaaaagccacatggtgttccgagtggaggtgctgtgcagcgggcgcagacacacggtgccaaggcgctacagcgagttccacgcgctgcacaagcggatcaagaagctgtacaaagtgcccgacttcccctcgaaacgcctgcccaactggaggaccagagggttggaacagcgccggcagggcttggaggcttacatccagggcatcctgtacctgaaccaggaggtgcccaaggagttactggaattcctgagacttcggcacttccccacagaccccaaggctagcaactgggggtaaggggggccgatggcgggggccaggggctgtcagcagtgagcagcaccctgagggagttcctgcctggcgacagcagctcccagcagcaccagcggcctgtcctgagcttccatgtggatccctatgtttgcaacccctccccagagtcgctgcccaacgtggtggtgaatggtgtgctccagggcctctacagcttcagcatcagcccagataaagcccagccaaaggcggcctgtcaccctgctcctctgccaccgatgccctgatcagtccagaggcctttggctgcctcctaagaaagtcatgtgcctctgtcctatgaactccatataaggctgggtcctcctttggcctggacccaggacttaattacccagtgcccagttgtgccacattcccactcaaggctcagaacttggctcgcattggtagctggaggtggtagaatttgtatgctcttagagcccaacagccaaggcagggtcaagaagataagtaataaaagaggaatcagctgggtgcagaggctcatgcctgtaatcccaatactttaggaggccaaggcaggaggatgcttgggtctggaagtttgagaccagccagcgcaacatagtgagacctgtctctaccaaaaaaaaaaaaaaaaaaaaaaaatcaatttagaggtaggctatgaaaaagtacagatacatcccttaacatagactggagggtggtggcaaggggagcaaatgtggaggcccagtagctggcaaagtttagaagcagggggcaaaagctcctgcctgacttttcctgggtagctcctgggtcaaaatttcaggcaggatcccagggaaggggcaggcacccattgccacaggagagttgcaggcatgttgggatgtaggcctaggggaggtgctgcaggctcaagaaccaggcccacacattatatattaaaaaaaaaaaaa

SEQ ID NO: 184998 - DNA, 2158 bp, Homo sapiens
  Payload ID: 16423
  Gene Symbol: SNX24
  Gene Name: sorting nexin 24
  Uniprot ID: Q9Y343
  ENST ID: ENST00000261369
  CDS Start-End: 186-695
ggcccccggcacgcccagggcgcgggagcggccgggtcagcccgcagacctgagtccggcccgcagcctcggggccccgcgggcgcagcggggcgggaggcggggcggcccggccgtgggcggagcggcggccgcggccgtgagcctgcccccaactcgccctcagccggctggccggcgcggccatggaggtctacatcccgtcctttcgctatgaagagagcgacctggagcggggatacacggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcgattttccaaatgtggttattgaaggagtcctccatgggatattttaccctcatctacagcccaggtagaaatcctacatggctaaaagaagcagaagcaagtttcgaagtcacagtcaaggaaatcaatacctaccaatttaacctaaacgctatgatatataacagctctagctagtggtaaagtgcacagtcccagcttaattcagggcagggacatttccattagaatggtgctcttaaaaatagaaactgaaccggggcggtggtcaggctaaggccaagtgtttaagaagtagagtgtagctgccagcgtagaaacccatgaaaaggaggccacaggagattcctgggagcactgggtgtagcaaaacaaagccactctctgcttcagtcgcaccatttgctaattgaaaatcatatcctgaatcatactgagactgatcaactttggtagcttttttgttcagatcttatgacacactactcttctcaccgtgagattttctcagccagtgatagtacattctgaaatgctggcaccaggagacggccacagacacacactgctaaatgtgaagatggaactaaactggaaattaaattatactgacaatattatggcatttttaagatcatggcattttaatttacattagagtggagttgcatcatactcaggggttagcttccaaggtcagtacataggtaaaatgggctattaggatgatccttgaaagccctttagaagggtgccatgttggaaacctgtacatccacaacaagtagcttttcctcctatgttggaaaaaaagactgtttctttgtttgaagaccaagtgaagttgttggtgtttgtttaggggccattttgttaaaaaaaaaaaaaaaaaagcacataacttttaacactagaatcagcccgcaagatgcttgccccgctagtggcagatgtgaactgacaaggagtgaagcgcccacccagcggatggacagcacccacctgggtttactcaagggtgtgcattcattttaggtgggatcgccacaggatttcatgttattttccttacggcttccttttcactgacctcatttgttgagttaatgtaagttaaatgtgtttatgatataactccactgtacatcatcctttgagtagtaaaggataaaagcatatatactacctatatgtatgtgctgtatgtgggcatttcattgagatctaattaatagctagcctatttatggttattcgttttagtaagttctgtgggagcaaggtatttaaaatcaaaactaataactacatcatggtttttgattaggatctaaatattcaggttttaagcctgctgcaaacttttaaaatattatgatagattctgtactacatgtgggaaacaagcaagaactaaataatcaaatgttgtcaaccaaaagtaatagttgggtattggagatttttttaaaatgtttttatgttattagctatttggagttaaataaaaacagaacaaggaaacatttga

SEQ ID NO: 184999 - DNA, 1050 bp, Homo sapiens
  Payload ID: 16423
  Gene Symbol: SNX24
  Gene Name: sorting nexin 24
  ENST ID: ENST00000395451
  CDS Start-End: 30-638
tcgccctcagccggctggccggcgcggccatggaggtctacatcccgtcctttcgctatgaagagagcgacctggagcggggatacacggtggtaatagtttggcatagagccttccagacaaaaatggaatcatatgaagttattgttctggaaattgctttttcaaatggaagacttacatatcaggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcgattttccaaatgtggttattgaaggagtcctccatgggatattttaccctcatctacagcccaggtagaaatcctacatggctaaaagaagcagaagcaagtttcgaagtcacagtcaaggaaatcaatacctaccaatttaacctaaacgctatgatatataacagctctagctagtggtaaagtgcacagtcccagcttaattcagggcagggacatttccattagaatggtgctcttaaaaatagaaactgaaccggggcggtggtcaggctaaggccaagtgtttaagaagtagagtgtagctgccagcgtagaaacccatgaaaaggaggccacaggagattcctgggagcactgggtgtagcaaaacaaagccactctctgcttcagtcgcaccatttgctaattgaaaatcatatcctgaatcatactgagactgatcaactttggtagcttttttgttcagatcttatgaca

SEQ ID NO: 185000 - DNA, 608 bp, Homo sapiens
  Payload ID: 16423
  Gene Symbol: SNX24
  Gene Name: sorting nexin 24
  ENST ID: ENST00000511545
  CDS Start-End: 1-67
tgaagagagcgacctggagcggggatacacggtgagggtcttgcagtgttgcccaggcaggccctgaactcctggtctcaagcgatcctaccgcttcagcctcccaagatgctggcattacagccgtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcgattttccaaatgtggttattgaaggagtcctccatgggatattttaccctcatctacagcccaggtagaaatcctacatggctaaaagaagcagaagcaag

SEQ ID NO: 185001 - DNA, 588 bp, Homo sapiens
  Payload ID: 16423
  Gene Symbol: SNX24
  Gene Name: sorting nexin 24
  Uniprot ID: Q9Y343
  ENST ID: ENST00000506996
  CDS Start-End: 9-488
gcgcggccatggaggtctacatcccgtcctttcgctatgaagagagcgacctggagcggggatacacggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcggtaatcaaacctgtcatctgctaacagctctttactgatctgaccctgcaccacataaaccacgtttttaatacaggtctaacagagtgacattggtcccgggcttaataatctgccaataaaccagtgctcttggta

SEQ ID NO: 185002 - DNA, 1563 bp, Homo sapiens
  Payload ID: 16423
  Gene Symbol: SNX24
  Gene Name: sorting nexin 24
  Uniprot ID: Q9Y343
  ENST ID: ENST00000513881
  CDS Start-End: 117-596
cggggccccgcgggcgcagcggggcgggaggcggggcggcccggccgtgggcggagcggcggccgcggccgtgagcctgcccccaactcgccctcagccggctggccggcgcggccatggaggtctacatcccgtcctttcgctatgaagagagcgacctggagcggggatacacggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcggtaatcaaacctgtcatctgctaacagctctttactgatctgaccctgcaccacataaaccacgtttttaatacagattttccaaatgtggttattgaaggagtcctccatgggatattttaccctcatctacagcccaggtagaaatcctacatggctaaaagaagcagaagcaagtttcgaagtcacagtcaaggaaatcaatacctaccaatttaacctaaacgctatgatatataacagctctagctagtggtaaagtgcacagtcccagcttaattcagggcagggacatttccattagaatggtgctcttaaaaatagaaactgaaccggggcggtggtcaggctaaggccaagtgtttaagaagtagagtgtagctgccagcgtagaaacccatgaaaaggaggccacaggagattcctgggagcactgggtgtagcaaaacaaagccactctctgcttcagtcgcaccatttgctaattgaaaatcatatcctgaatcatactgagactgatcaactttggtagcttttttgttcagatcttatgacacactactcttctcaccgtgagattttctcagccagtgatagtacattctgaaatgctggcaccaggagacggccacagacacacactgctaaatgtgaagatggaactaaactggaaattaaattatactgacaatattatggcatttttaagatcatggcattttaatttacattagagtggagttgcatcatactcaggggttagcttccaaggtcagtacataggtaaaatgggctattaggatgatccttgaaagccctttagaagggtgccatgttggaaacctgtacatccacaacaagtagcttttcctcctatgttggaaaaaaagactgtttctttgtttgaagaccaagtgaagttgttggtgtttgtttaggggccattttgttaaaaaaaaaaaaaaaaaagcacataacttttaacactagaatcagcccgcaaga

SEQ ID NO: 185003 - DNA, 554 bp, Homo sapiens
  Payload ID: 16423
  Gene Symbol: SNX24
  Gene Name: sorting nexin 24
  ENST ID: ENST00000503149
  CDS Start-End: 1-207
gtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacagagaaatgtgggtgcttaatcaagaaaaataatttcttctgttgatttggcttatttggagaaaagataattgtgtaaaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcgattttccaaatgtggttattgaaggagtcctccatgggatattttaccctcatctacagcccaggtagaaatcctacatggctaaaagaagca

SEQ ID NO: 185004 - DNA, 3264 bp, Homo sapiens
  Payload ID: 16424
  Gene Symbol: SNX25
  Gene Name: sorting nexin 25
  Uniprot ID: Q9H3E2
  ENST ID: ENST00000264694
  CDS Start-End: 241-2763
gcggggctgagctccgtcctgttcaggctcagcctgtacctgagctgcgcggcggccgccttcctgctggggatcctgtttgccctcgtctgccggagcccgcgcgcccagccgcccgacttcgccgccgcctggagccggctggccgcgacctcagccgcccgccgcccgccggggagtcctgtgtatggaaactcacatgagtcagctcagtctagaagggtagtaatttctcataatatggataaagctctgaaagaagtgttcgactacagttatagagattacattctgtcctggtatggaaacctcagcagagatgagggacaactttaccatctgctcttggaagacttttgggaaattgccagacagctgcaccacagactgagtcacgtggatgtggttaaagttgtctgcaatgatgttgtgaggactttactcactcatttctgtgacctgaaagctgccaatgccagacatgaagaacagccaagaccttttgtgttgcacgcatgcttgaggaactcagatgatgaagtaagatttctacaaacgtgttctcgggttctggtgttttgtctcctcccctcaaaggatgtgcagtctctcagcttacgtataatgcttgcagaaattctcacaacaaaagtcttgaagccggtagtggagttactgagtaatccagattacattaaccaaatgctgcttgcccagctggcgtacagagagcaaatgaatgagcatcacaagagagcctacacctatgccccctcttacgaggacttcatcaagctcattaacagcaactctgatgtggagttcttgaagcaactaaggtatcaaattgtagtggaaataatccaggcgactacaattagcagctttccccaactgaagaggcacaaaggtaaagaaactgcggcaatgaaagctgatctcctgagggccaggaacatgaagaggtacatcaaccaactgactgtggcaaagaagcagtgtgagaagagaatccgaatcctgggaggccctgcctatgaccagcaagaggatggggccctggatgagggggaagggcctcaaagccagaagattcttcagtttgaagatatcttggccaatacgttctaccgagagcactttggaatgtacatggaaaggatggacaaaagagctctgattagtttttgggaatctgtggaacatttaaagaatgctaacaagaatgaaattccacaattagttggtgaaatttatcagaatttctttgtggagagcaaagaaatatctgtggaaaaatcactttacaaagaaattcagcagtgtcttgtaggaaataaaggtattgaagtattctacaaaatccaggaagatgtttatgagaccctaaaggataggtattacccttcatttattgtcagtgacctgtatgagaaattgttgataaaagaggaagaaaaacatgcctcacagatgatttccaacaaggatgagatgggcccaagagatgaggctggtgaggaagccgtggatgatggtaccaatcagatcaatgaacaagccagttttgctgtaaacaaactgcgagaactaaatgagaaacttgaatataaaaggcaagctctaaattctattcaaaatgcaccaaaacctgacaagaagattgtttccaagttgaaggatgaaataatcctaatagagaaagaacgcacagaccttcagctgcacatggcaagaacggattggtggtgtgaaaaccttggcatgtggaaagcctccatcaccagtggagaggttacagaagagaatggtgagcaattgccatgttactttgtcatggtaagcctacaagaagttggaggagttgaaactaagaactggacggtccccagaaggctcagcgagtttcagaatttacaccggaaactcagtgagtgcgtcccttctttaaaaaaagtccagttgccttctcttagcaagctgcctttcaaatctatagatcaaaagtttatggaaaagtcgaagaatcaattaaataagtttttacagaatctgctttcagatgaaagactgtgtcagagtgaagcactttatgccttcttgagcccttctcctgactacctcaaggttatcgacgtgcaggggaaaaaaaattctttttcattatcctcatttttggaaagacttcctcgcgacttcttctcccaccaggaggaggagacagaggaggacagtgacctgtcagattatggtgatgatgtggatgggaggaaagacgccttggctgaaccatgtttcatgttgattggggagatttttgaacttcgaggaatgtttaaatgggtgagaagaacattaattgccctcgttcaggtcacttttggaagaaccatcaacaaacaaatccgggacacagtcagctggattttcagtgagcaaatgttggtttactacatcaatattttccgggatgctttttggccaaatgggaagttggcaccaccgaccacaatcagaagcaaagagcaaagtcaggaaacaaaacagagagcacagcaaaagctgcttgaaaacattccagatatgcttcagagccttgttggacagcaaaatgcccgccacggtataataaaaatattcaatgcactgcaagaaacaagagccaacaagcatctgttatatgcgctgatggaactgctgctaattgaactgtgtcctgagctgagagttcatttagatcaacttaaagctggccaagtttgagactacacaaataaaccaccagaaaaatgtctgtgtaataatagacatgaaacattttcctcttttccacagagggcttaactgagaaccgtattgatttttattttagttacctccctctagttttatgtgaaattagtagaatcagggaggacgggacttatgctgtggtaggcaacagaaaaaaacttctattgattttaatttaatatgaatactttaaagatcaacataccgattgaaatacaaatgttaatatgtgagaacctaggaagtattttaaatatttatgaaaatattttgttttaaaatgaactatgaatattgtacagttaatttcctcactgaggactgtgaacattcttatattatttcatgtatattgaagaacattgttatgcaatgctttgtgtaaagttattgtgaagattttattgtctttatttttaccaaagatttcccatagtttgagcattcaaagcaataaaatataaaaatgaa

SEQ ID NO: 185005 - DNA, 1868 bp, Homo sapiens
  Payload ID: 16424
  Gene Symbol: SNX25
  Gene Name: sorting nexin 25
  ENST ID: ENST00000504959
  CDS Start-End: 1-428
atttaaagaatgctaacaagaatgaaattccacaattagttggtgaaatttatcagaatttctttgtggagagcaaagaaatatctgtggaaaaatcactttacaaagaaattcagcagtgtcttgtaggaaataaaggtattgaagtattctacaaaatccaggaagatgtttatgagaccctaaaggataggtattacccttcatttattgtcagtgacctgtatgagaaattgttgataaaagaggaagaaaaacatgcctcacagatgatttccaacaaggatgagatgggcccaagagatgaggctggtgaggaagccgtggatgatggtaccaatcagatcaatgaacaagccagttttgctgtaaacaaactgcgagaactaaatgagaaacttgaatataaaagattgtttccaagttgaaggatgaaataatcctaatagagaaagaacgcacagaccttcagctgcacatggcaagaacggattggtggtgtgaaaaccttggcatgtggaaagcctccatcaccagtggagaggttacagaagagaatggtgagcaattgccatgttactttgtcatggtaagcctacaagaagttggaggagttgaaactaagaactggacggtccccagaaggctcagcgagtttcagaatttacaccggaaactcagtgagtgcgtcccttctttaaaaaaagtccagttgccttctcttagcaagctgcctttcaaatctatagatcaaaagtttatggaaaagtcgaagaatcaattaaataagtttttacagaatctgctttcagatgaaagactgtgtcagagtgaagcactttatgccttcttgagcccttctcctgactacctcaaggttatcgacgtgcaggggaaaaaaaattctttttcattatcctcatttttggaaagacttcctcgcgacttcttctcccaccaggaggaggagacagaggaggacagtgacctgtcagattatggtgatgatgtggatgggaggaaagacgccttggctgaaccatgtttcatgttgattggggagatttttgaacttcgaggaatgtttaaatgggtgagaagaacattaattgccctcgttcaggtcacttttggaagaaccatcaacaaacaaatccgggacacagtcagctggattttcagtgagcaaatgttggtttactacatcaatattttccgggatgctttttggccaaatgggaagttggcaccaccgaccacaatcagaagcaaagagcaaagtcaggaaacaaaacagagagcacagcaaaagctgcttgaaaacattccagatatgcttcagagccttgttggacagcaaaatgcccgccacggtataataaaaatattcaatgcactgcaagaaacaagagccaacaagcatctgttatatggaacttcaacaaatacgcttctgtctcctagagaccatgattgaaattttctgaaataaggcctgaactttggaatttgtaaaagatcctcgggtgattttaacatgcagagaagcttgggaaccactgctgtaatatcagagtcagccaagggactcagaagactcccccactcaggctgaacaatctgtgttccacaaacactgctctaccaagtctgctatgatgtaattctgactcgtggatgtgatggacctaagatgtgcacagctttttggtttttctttttttaaaaaaaatctaaacttaagagttagtactcataatgatctcccttacaccccctccactaccacaccccttgctttttagtatttactttgagatgtgaaacgcatttgggatctaaataaattgatcacatggattaaaata

SEQ ID NO: 185006 - DNA, 3323 bp, Homo sapiens
  Payload ID: 16424
  Gene Symbol: SNX25
  Gene Name: sorting nexin 25
  Uniprot ID: Q9H3E2
  ENST ID: ENST00000504273
  CDS Start-End: 295-2817
ctgctcccggctgcctagggcggcgcgggtaggccccgttgttctcgtgcgttaatagggaaagctgccttgattatcttgtaattctctaccaaaccaagaataaaaaagaacggcggctgtgtgtttgtgatattttctatcagcaaatttcagttcataccactagttagttctgtggaccagaggctggtttcagaatggaaagacctttgccgagtggtaaacgagagtcctgtgtatggaaactcacatgagtcagctcagtctagaagggtagtaatttctcataatatggataaagctctgaaagaagtgttcgactacagttatagagattacattctgtcctggtatggaaacctcagcagagatgagggacaactttaccatctgctcttggaagacttttgggaaattgccagacagctgcaccacagactgagtcacgtggatgtggttaaagttgtctgcaatgatgttgtgaggactttactcactcatttctgtgacctgaaagctgccaatgccagacatgaagaacagccaagaccttttgtgttgcacgcatgcttgaggaactcagatgatgaagtaagatttctacaaacgtgttctcgggttctggtgttttgtctcctcccctcaaaggatgtgcagtctctcagcttacgtataatgcttgcagaaattctcacaacaaaagtcttgaagccggtagtggagttactgagtaatccagattacattaaccaaatgctgcttgcccagctggcgtacagagagcaaatgaatgagcatcacaagagagcctacacctatgccccctcttacgaggacttcatcaagctcattaacagcaactctgatgtggagttcttgaagcaactaaggtatcaaattgtagtggaaataatccaggcgactacaattagcagctttccccaactgaagaggcacaaaggtaaagaaactgcggcaatgaaagctgatctcctgagggccaggaacatgaagaggtacatcaaccaactgactgtggcaaagaagcagtgtgagaagagaatccgaatcctgggaggccctgcctatgaccagcaagaggatggggccctggatgagggggaagggcctcaaagccagaagattcttcagtttgaagatatcttggccaatacgttctaccgagagcactttggaatgtacatggaaaggatggacaaaagagctctgattagtttttgggaatctgtggaacatttaaagaatgctaacaagaatgaaattccacaattagttggtgaaatttatcagaatttctttgtggagagcaaagaaatatctgtggaaaaatcactttacaaagaaattcagcagtgtcttgtaggaaataaaggtattgaagtattctacaaaatccaggaagatgtttatgagaccctaaaggataggtattacccttcatttattgtcagtgacctgtatgagaaattgttgataaaagaggaagaaaaacatgcctcacagatgatttccaacaaggatgagatgggcccaagagatgaggctggtgaggaagccgtggatgatggtaccaatcagatcaatgaacaagccagttttgctgtaaacaaactgcgagaactaaatgagaaacttgaatataaaaggcaagctctaaattctattcaaaatgcaccaaaacctgacaagaagattgtttccaagttgaaggatgaaataatcctaatagagaaagaacgcacagaccttcagctgcacatggcaagaacggattggtggtgtgaaaaccttggcatgtggaaagcctccatcaccagtggagaggttacagaagagaatggtgagcaattgccatgttactttgtcatggtaagcctacaagaagttggaggagttgaaactaagaactggacggtccccagaaggctcagcgagtttcagaatttacaccggaaactcagtgagtgcgtcccttctttaaaaaaagtccagttgccttctcttagcaagctgcctttcaaatctatagatcaaaagtttatggaaaagtcgaagaatcaattaaataagtttttacagaatctgctttcagatgaaagactgtgtcagagtgaagcactttatgccttcttgagcccttctcctgactacctcaaggttatcgacgtgcaggggaaaaaaaattctttttcattatcctcatttttggaaagacttcctcgcgacttcttctcccaccaggaggaggagacagaggaggacagtgacctgtcagattatggtgatgatgtggatgggaggaaagacgccttggctgaaccatgtttcatgttgattggggagatttttgaacttcgaggaatgtttaaatgggtgagaagaacattaattgccctcgttcaggtcacttttggaagaaccatcaacaaacaaatccgggacacagtcagctggattttcagtgagcaaatgttggtttactacatcaatattttccgggatgctttttggccaaatgggaagttggcaccaccgaccacaatcagaagcaaagagcaaagtcaggaaacaaaacagagagcacagcaaaagctgcttgaaaacattccagatatgcttcagagccttgttggacagcaaaatgcccgccacggtataataaaaatattcaatgcactgcaagaaacaagagccaacaagcatctgttatatgcgctgatggaactgctgctaattgaactgtgtcctgagctgagagttcatttagatcaacttaaagctggccaagtttgagactacacaaataaaccaccagaaaaatgtctgtgtaataatagacatgaaacattttcctcttttccacagagggcttaactgagaaccgtattgatttttattttagttacctccctctagttttatgtgaaattagtagaatcagggaggacgggacttatgctgtggtaggcaacagaaaaaaacttctattgattttaatttaatatgaatactttaaagatcaacataccgattgaaatacaaatgttaatatgtgagaacctaggaagtattttaaatatttatgaaaatattttgttttaaaatgaactatgaatattgtacagttaatttcctcactgaggactgtgaacattcttatattatttcatgtatattgaagaacattgttatgcaatgctttgtgtaaagttattgtgaagattttattgtctttatttttaccaaagatttcccatagtttgagcattcaaagcaataaaatataaaaatgaatcaca

SEQ ID NO: 185007 - DNA, 3151 bp, Homo sapiens
  Payload ID: 16424
  Gene Symbol: SNX25
  Gene Name: sorting nexin 25
  Uniprot ID: Q9H3E2
  ENST ID: ENST00000618785
  CDS Start-End: 982-2652
ctgctcccggctgcctagggcggcgcgggtaggccccgttgttctcgtgcgttaatagggaaagctgccttgattatcttgtaattctctaccaaaccaagaataaaaaagaacggcggctgtgtgtttgtgatattttctatcagcaaatttcagttcataccactagttagttctgtggaccagaggctggtttcagaatggaaagacctttgccgagtggtaaacgagagtcctgtgtatggaaactcacatgagtcagctcagtctagaagggtagtaatttctcataatatggataaagctctgaaagaagtgttcgactacagttatagagattacattctgtcctggtatggaaacctcagcagagatgagggacaactttaccatctgctcttggaagacttttgggaaattgccagacagctgcaccacagactgagtcacgtggatgtggttaaagttgtctgcaatgatgttgtgaggactttactcactcatttctgtgacctgaaagctgccaatgccagacatgaagaacagccaagaccttttgtgttgcacgcatgcttgaggaactcagatgatgaagtaagatttctacaaacgtgttctcgggttctggtgttttgtctcctcccctcaaaggatgtgcagtctctcagcttacgtataatgcttgcagaaattctcacaacaaaagtcttgaagccggtagtggagttactgagtaatccagattacattaaccaaatgctgcttgcccagctggcgtacagagagcaaatgaatgagcatcacaagagagcctacacctatgccccctcttacgaggacttcatcaagctcattaacagcaactctgatgtggagttcttgaagcaactaaggtatcaaattgtagtggaaataatccaggcgactacaattagcagctttccccaactgaagaggcacaaaggtaaagaaactgcggcaatgaaagctgatctcctgagggccaggaacatgaagaggtacatcaaccaactgactgtggcaaagaagcagtgtgagaagagaatccgaatcctgggaggccctgcctatgaccagcaagaggatggggccctggatgagggggaagggcctcaaagccagaagattcttcagtttgaagatatcttggccaatacgttctaccgagagcactttggaatgtacatggaaaggatggacaaaagagctctgattagtttttgggaatctgtggaacatttaaagaatgctaacaagaatgaaattccacaattagttggtgaaatttatcagaatttctttgtggagagcaaagaaatatctgtggaaaaatcactttacaaagaaattcagcagtgtcttgtaggaaataaaggtattgaagtattctacaaaatccaggaagatgtttatgagaccctaaaggataggtattacccttcatttattgtcagtgacctgtatgagaaattgttgataaaagaggaagaaaaacatgcctcacagatgatttccaacaaggatgagatgggcccaagagatgaggctggtgaggaagccgtggatgatggtaccaatcagatcaatgaacaagccagttttgctgtaaacaaactgcgagaactaaatgagaaacttgaatataaaaggcaagctctaaattctattcaaaatgcaccaaaacctgacaagaagattgtttccaagttgaaggatgaaataatcctaatagagaaagaacgcacagaccttcagctgcacatggcaagaacggattggtggtgtgaaaaccttggcatgtggaaagcctccatcaccagtggagaggttacagaagagaatggtgagcaattgccatgttactttgtcatggtaagcctacaagaagttggaggagttgaaactaagaactggacggtccccagaaggctcagcgagtttcagaatttacaccggaaactcagtgagtgcgtcccttctttaaaaaaagtccagttgccttctcttagcaagctgcctttcaaatctatagatcaaaagtttatggaaaagtcgaagaatcaattaaataagtttttacaggaggagacagaggaggacagtgacctgtcagattatggtgatgatgtggatgggaggaaagacgccttggctgaaccatgtttcatgttgattggggagatttttgaacttcgaggaatgtttaaatgggtgagaagaacattaattgccctcgttcaggtcacttttggaagaaccatcaacaaacaaatccgggacacagtcagctggattttcagtgagcaaatgttggtttactacatcaatattttccgggatgctttttggccaaatgggaagttggcaccaccgaccacaatcagaagcaaagagcaaagtcaggaaacaaaacagagagcacagcaaaagctgcttgaaaacattccagatatgcttcagagccttgttggacagcaaaatgcccgccacggtataataaaaatattcaatgcactgcaagaaacaagagccaacaagcatctgttatatgcgctgatggaactgctgctaattgaactgtgtcctgagctgagagttcatttagatcaacttaaagctggccaagtttgagactacacaaataaaccaccagaaaaatgtctgtgtaataatagacatgaaacattttcctcttttccacagagggcttaactgagaaccgtattgatttttattttagttacctccctctagttttatgtgaaattagtagaatcagggaggacgggacttatgctgtggtaggcaacagaaaaaaacttctattgattttaatttaatatgaatactttaaagatcaacataccgattgaaatacaaatgttaatatgtgagaacctaggaagtattttaaatatttatgaaaatattttgttttaaaatgaactatgaatattgtacagttaatttcctcactgaggactgtgaacattcttatattatttcatgtatattgaagaacattgttatgcaatgctttgtgtaaagttattgtgaagattttattgtctttatttttaccaaagatttcccatagtttgagcattcaaagcaataaaatataaaaatg

SEQ ID NO: 185008 - DNA, 536 bp, Homo sapiens
  Payload ID: 16425
  Gene Symbol: SNX29
  Gene Name: sorting nexin 29
  ENST ID: ENST00000562510
  CDS Start-End: 1-210
caggagctcatcgatctccggggaccggtgcctggagatttgagtcaaacgtccgaagaccagagtttgtcggattttgaaatatcaaaccgggcgctgatcaacgtctggatcccctcagtgtttctccggggcaaagcagcaaatgcattccacgtgtatcagctatttaaaaatgtgaaaatcattcttagtctgtgggccgtatgaaaacagccagcaggccaggcgtccagcctggtttgagaggagtgcgtctggagggaacagtgtgtcagaggaagatggagcatctgcctaaatcctgccgggcctagggcctgcgtgggctttctctgtcatgctccttcctatggaagctgctcagtagatcctgctggggacatggcattgcggcactgagacatcagagcagggtcacctgtgtgctactagaggggcccacgctgttcctccctgactactctaccaacccctggccaaggcagcagagagagtctttgcgcagatactctgataaatcaaactacaatgga

SEQ ID NO: 185009 - DNA, 683 bp, Homo sapiens
  Payload ID: 16425
  Gene Symbol: SNX29
  Gene Name: sorting nexin 29
  ENST ID: ENST00000563308
  CDS Start-End: 1-527
ggggccactcggagtcgcccgagaagccactggaagggaacacctgcctctcccagatgcacagctgggctccgctgaaggtgctgcacaatgactccgacatcctcttccctgtcagtggcgtgggctcctacagcccagcagatgcccccctcggaagcctggagaacgggacaggaccagaggaccacgttctcccagatcctggacttcggtacagtgtggaagccagctctccaggccacggaagtcctctgagcagcctgttaccttctgcctcagtgccagagtccatgacaattagtgaactgcgccaggccactgtggccatgatgaacaggaaggatgagctggaggaggagaacagatcactgcgaaacctgctcgacggtgagatggagcactcagccgcgctccggcaagaggtggacaccttgaaaaggaaggtggctgaacaggaggagcggcagggcatgaaggtccaggcgctggccagctatctttgctattttgtgaggagattctaaccccacgtgagaaccatgtggtggagaaatggagggagagagaaatcaacagttcctgatagtctcatttgagctcctggatccagtctttcctgaagctgtgtttcctctggacttttcatgtatgtgagccaataaattgctttcattccttga

SEQ ID NO: 185010 - DNA, 8171 bp, Homo sapiens
  Payload ID: 16425
  Gene Symbol: SNX29
  Gene Name: sorting nexin 29
  Uniprot ID: Q8TEQ0
  ENST ID: ENST00000566228
  CDS Start-End: 70-2511
ggagctcggcagccgcagaagcggcagcggcggcggcgcggcgcaggcaccggcccggggagaggcaccatgagcggatcacagaacaatgacaaaagacaatttctgctggagcgactgctggatgcagtgaaacagtgccagatccgctttggagggagaaaggagattgcctcggattccgacagcagggtcacctgtctgtgtgcccagtttgaagccgtcctgcagcatggcttgaagaggagtcgaggattggcactcacagcggcagcgatcaagcaggcagcgggctttgccagcaaaaccgaaacagagcccgtgttctggtactacgtgaaggaggtcctcaacaagcacgagctgcagcgcttctactccctgcgccacatcgcctcagacgtgggccggggtcgcgcctggctgcgctgtgccctcaacgaacactccctggagcgctacctgcacatgctcctggccgaccgctgcaggctgagcactttttatgaagactggtcttttgtgatggatgaagaaaggtccagtatgcttcctaccatggcagcaggtctgaactccatactctttgcgattaacatcgacaacaaggatttgaacgggcagagtaagtttgctcccaccgtttcagacctcttaaaggagtcaacgcagaacgtgacctccttgctgaaggagtccacgcaaggagtgagcagcctgttcagggagatcacagcctcctctgccgtctccatcctcatcaaacctgaacaggagaccgaccccttgcctgtcgtgtccaggaatgtcagtgctgatgccaaatgcaaaaaggagcggaagaagaaaaagaaagtgaccaacataatctcatttgatgatgaggaagatgagcagaactctggggacgtgtttaaaaagacacctggggcaggggagagctcagaggacaactccgaccgctcctctgtcaatatcatgtccgcctttgaaagccccttcgggcctaactccaatggaagtcagagcagcaactcatggaaaattgattccctgtctttgaacggggagtttgggtaccagaagcttgatgtgaaaagcatcgatgatgaagatgtggatgaaaacgaagatgacgtgtatggaaactcatcaggaaggaagcacaggggccactcggagtcgcccgagaagccactggaagggaacacctgcctctcccagatgcacagctgggctccgctgaaggtgctgcacaatgactccgacatcctcttccctgtcagtggcgtgggctcctacagcccagcagatgcccccctcggaagcctggagaacgggacaggaccagaggaccacgttctcccagatcctggacttcggtacagtgtggaagccagctctccaggccacggaagtcctctgagcagcctgttaccttctgcctcagtgccagagtccatgacaattagtgaactgcgccaggccactgtggccatgatgaacaggaaggatgagctggaggaggagaacagatcactgcgaaacctgctcgacggtgagatggagcactcagccgcgctccggcaagaggtggacaccttgaaaaggaaggtggctgaacaggaggagcggcagggcatgaaggtccaggcgctggccagagagaacgaggtgctcaaagtccaactgaagaaatatgtaggagctgtccagatgctgaaaagagaaggtcaaacagctgaagtgccaaatctttggagtgttgatggagaagttacagtagctgaacagaagccgggagaaattgctgaagaactcgcaagctcctacgaaagaaagctcatcgaggtggcagagatgcatggcgagctgattgagttcaacgagcgcctgcacagggccctggtagccaaggaagccctcgtgtcccagatgaggcaggagctcatcgatctccggggaccggtgcctggagatttgagtcaaacgtccgaagaccagagtttgtcggattttgaaatatcaaaccgggcgctgatcaacgtctggatcccctcagtgtttctccggggcaaagcagcaaatgcattccacgtgtatcaggtctacatccggataaaagacgatgaatggaatatttatcgccggtatacagagttcaggagtttgcaccacaagttacaaaacaagtaccctcaagtgagggcctacaacttcccacccaaaaaggccattggaaacaaggatgccaagtttgtggaggaacggagaaagcagctccagaattacctgcgcagcgtcatgaacaaagtcatccagatggtccccgagttcgctgccagccccaagaaggagaccctcatccagctgatgcccttcttcgtcgacatcaccccgcccggagagcctgtgaacagccggcccaaagcagcttcccgcttccccaaactgtcccggggtcagccccgggagacccgcaacgtggagccccagagcggtgacctctgacctcgacaaaaccgcagccacgggccctgtgcgtggcaccagctgcgtccaccccagccactgccgctggcccctcacctcagcgtgacaaccacgtccacctggtgatcctgagagcacacgattcccaacagttacacaacaccccgattaaactaatcagtcttcgagccgcatgataccgtgacccgagagaccaaggcagcacctcgctggagagactgggacacacagtccttctgcttctggggtctaccctgggctgcaagggctgttcctccacctttctgtagttcagggctggcaggagggtgggcaccaggtcaggctgggtgcgccatggttgagaggcaaaggtgatcccctatataggaaggttcatgcagagccagcctctccactctttcccacgtggggactagaatgactattagcctctccttttgctttttaaggttattacctggcctaacctagggatggctggctttgcgggggggggggggggggggggcatggttcctttcactgcattttccaccaacagtcattagacacctggcactgtcacagctcacttttccagagggatattcctgtggctttggcaaggagccattagtgatgtgcaacttgagttcagagaacttcccctacctcccccatggctggcttcaggaaggaccagtgccctccatagcctgaggccacctaggccctcgccaggcttggagtggggggactcagacatctggcccagccatcagcagcaacctagtaacccggcgtcatccagcgtgtccaaagtagcattggccctacagtcatgagagacttgggtcagggaaccactgcagaaggttccagggttttcaaaccaggctccatgactatgaagttggacccagtgtggacacttaacagatcatgtgtctctccactaaaaacattttccatcccgtctgcccccgacattgtccttgataacagaactctgcatcccctaagacagagtcctctgttcctcccatgtcaggtggctctcagagtacagggaccttggcaggtggagaggaggatggggaccagcagctgggcagcccccagggctcctcctccagtgagctcacatcagagcacctcacagagcaatagccgtcctcagatgctcagcaaagttgtggcagtttgcatttctagggtaaactaactaggaaggatgtcgtgaaatggactatgcaagagtaagtttgtgtgtttcgccttaatctgaggcagagacacagcagaacctgaggagaaaagcaggtggaaggtgacggttagatggtaagccatgggcttgtcctggaactgcttcaactcagtggcttaaaatgagaactgcccaggtgagcatggagcatctcctaggctcgaggacatctctggagaatcatctggaaggtttatactgtgccttcccctcgtagcaaaaaggaagattgttcatggcctttaaggaaggctgagatcactcacacacagcgcccccccaccccagagaaaccgagtcagcctacatgacttccaaggggacctggggccagataagccctgccccggtgagaccaaatgagctggagcatgtatggaggtgcggaccctgcagtcagtttgcgagtgtggaggacccgagacatcctgtaaaggcaacttggtctccctcccactcacctgccaacattgctgcaatacacatggtttatctgaaattccaaggccagagtgcacatcagctcacatgactggcaactctaaatagagagccctaatggactgaggcaggaaacgtctaaaagctcaatctgctgtatgtcatgaccccttaggttgggtttatgccacatcggtcattttgaagtaggtgtttgatgccagctcagagactgtctcaggagtgcctccctggcctgggtagctaccctggaggtcatctccctgttctctgttggataaaggaacctcccccatctgtgacattcccttgggcccaggcttatgacctgcaccttttctgacacctgcccccaaagcacaggatgtgaattggtctctctccagataccccacgaggaagcaccttggacattctgcacatgataataatgcaacagtcccccattgctgagagatactaacccgtgagaaacaagtatgctctcagctggtattgaactggtgggagaaactgcctcctacttttataatactgaattattcacaaaaaacctggtctgctctccaaaatgagagcatgttcctgggagccacatggggaccatccccagctgcctgctcctggtacctcccccatgatcatgcacagaccgtagagtcgagtcatctcgcagatccagaccatctcctctcattctcactctaaaaatgctggtggcccgcacatgacagcaactccccgaagccttccctttggaatcccatagaatgttctgcaatgattgggtccatcttgctgctcagaagaatcccgtcctgctctctagtgtggtgggatgaacttcaggcaacaaacaactggcagggttcccagttcctggagttatggagcagaaacacccaggcctagcagaattgtggctgaaacctggtgcccaaattccacaccctggaaatgtgtcaactgcctgtcagcctggattcaattctgagggctaagccacgaccttatccatgagtggcgaagacacccctgaggaaaggattgcttgcacctcacatctgtcttcttctaagattactcggagattttcaaacaacatctgagaacagaagccccctcccctactcagagaggaacgagggtggcccacctctcaagggccttggattcctgggaccaccctttgctgggaggaagaatccacaccgaatccttctgtcttcatggcctgctgtgctgaaacagaacagcaggttccatctttcacatctttttttctcccccagatgaaagacgactcaggaacggtagggctgggcagaggtgtctctccttgagagacaacaaaagcttctaagggagggagcttaaaggctgctagaaacctagcccaaccatccactcctgatctgagacagaaccttctccgccactcttcctgcaatcagtgtgaaattccagcttctttgattcccacttagcagtatgctccaatcacgttgctggcaaggcattttagagtttggagctgaggttcaaagccccctgcatttctctactggcaggccctggtgaaggaagacactttcagggaagaggctcttacagtctatggtggtagccatcttcacatccagtcaccagttgcatctagggagctgctggctataaaagggatcatccagtggagttgtaaacaagggaaccatcttgcaagatctaggaagaggaaggggagggatgtggactgggtctgatcacagcccttggccctgcttcatactttggagcttattaagatcaattttgataaccatgtaatttcttagaaccatggcaggtagtattgtgctttaaaaaccagaggctcctgaaagtcgtttacaccaggtggattgataccatggctgtagctgatgcaactaacaagtactggggccagtgatcacaatccaggttggaaacaggagtgaagcccaccagcctgcctggttgatggacagcaggctctgccttctggaggcggcttatatcccaacagcctgaggcagggctctgtggcccaggccggcagtggctgcctctcttggttctgcatggtacattttgccaaccctgaggaccagttcttggggttccaggcctcggccttcctgctccacgtgctcaagcccccacagggggctgcgacaccatctggctcctcacagggaggtccagccatgttctctgggctcccagtgagccccctcccctccggctacccccagaatccatccttcattcctccaccaagctcctgtgtgagctgcagcacccacacgggggaagccctgcactccagcagcatcttccagccttggcacagaactgatggcaaaggaagggctgggttttcagcttctgggacccgaggaagaccccacctcactcctccttccccagtacatcagactggttaggaggcatcccagaaggggcagcctcatgcccaggtttcagccctaaaggtaatgattgtcttgactctgccttggcatttcgctcggaatcacggcagacttggagtgtttcttcaaggcaggcatctgcttatgagcaaggtcaaagatttttcaaaatattgtgcattaattcattaaagctactgttaaatatttgctgtttttagattggcgtccgtgctaattctgcagttgtagcactgtatattttatctcatttctgtgccaagaaagttcatctttatgtttttctaatacacaatcttgatcttgtttccaaaataaagcttcagctccttggtcaatagaagtaagggtgtagccatccagggtctcccggctctaggcagaccggatcccgcagttcatcccatggttgttgaaatgtacctcgatcagtcatctctggtattcctcactctagccatgagccattgccatcttatgggcccgatttgggtactctgaattatgtcatggagtagacagttacttctaaatcccagcaaccaagttgcgtatccttccttatagctagtttctatagagaagtgaaaaagaaatctggcttccttaataagatagttgagcctatgacattaaggagcagcgctgctggcggaagattctagattcactggtggtttaagaggcccagggatttagttcttactggtgcgtaagtgttttcccatcctaaccggaaaaccactcacccaggcttcccccacttcccctcaaattttctcagctctgccgctggtctccatgaacggcaaggggaaccaccactcattcactgtcagtgtaggtaagacagaggatgcccttgcaaaaattgggactgaggacagtagcacacggaatggtggatcgtacatttgcacccagagctactaaacgctcagtgaccccagagaccattaatttcccggagtgaaggggatgggggtagagctaattggaatttttattatccaggactcatcctaagaagaatgttggcctctcttcatccctggcttagccgtcaggtagaacgcttactcacctgacaccgacttcttagagaagcgagtcttttttgaatggaggagcgatggtaaccccactagggggcgcccatgatcggctcccagtgcacccccttaagggtaagcaggccacatatctagagtctgatagtctgtgtgtacataaggtctagaagtctgtggaaacgccctgaaacctgtagtattatcttaactaccctcttatgttaaggtttacataataggatttttaaacaaatgtgtttaattttttaagatctcttgtattaaaattttcttttggaataagctgtggaaattttgttacaacctggttgagatcaacctctttacaatgacacaaattgtgacattttataaattagatacttcagtgga

SEQ ID NO: 185011 - DNA, 1633 bp, Homo sapiens
  Payload ID: 16425
  Gene Symbol: SNX29
  Gene Name: sorting nexin 29
  ENST ID: ENST00000564791
  CDS Start-End: 1-849
ttgaaaaggaaggtggctgaacaggaggagcggcagggcatgaaggtccaggcgctggccagagagaacgaggtgctcaaagtccaactgaagaaatatgtaggagctgtccagatgctgaaaagagaaggtcaaacagctgaagtgccaaatctttggagtgttgatggagaagttacagtagctgaacagaagccgggagaaattgctgaagaactcgcaagctcctacgaaagaaagctcatcgaggtggcagagatgcatggcgagctgattgagttcaacgagcgcctgcacagggccctggtagccaaggaagccctcgtgtcccagatgaggcaggagctcatcgatctccggggaccggtgcctggagatttgagtcaaacgtccgaagaccagagtttgtcggattttgaaatatcaaaccgggcgctgatcaacgtctggatcccctcagtgtttctccggggcaaagcagcaaatgcattccacgtgtatcaggtctacatccggataaaagacgatgaatggaatatttatcgccggtatacagagttcaggagtttgcaccacaagttacaaaacaagtaccctcaagtgagggcctacaacttcccacccaaaaaggccattggaaacaaggatgccaagtttgtggaggaacggagaaagcagctccagaattacctgcgcagcgtcatgaacaaagtcatccagatggtccccgagttcgctgccagccccaagaaggagaccctcatccagctgatgcccttcttcgtggactggatctcactgtttggaaatggccgcgatagttcacgtgaggagttctcatcctcttagcggcatccccatggcccagggtgcacgggggaattagcctctcgcggagtcatcacgcatcgactgaattccctggtgaaaactgagttagccagttgttcctaagatactcctgatgctgagagtgtgagcaggaggcgctgccccatccgcaagtcagtgtcccccaccccctgcggggtccacagcccaggcatctccggtccagtgtttcccaaacattcgcgtgccgaattgtaaaaagtgcacgttaatgcgagcctgtcggtgtgacatgaatctcagccatgctggttgccatcagtcagcacggagagagaaaccttttgtgcctaattagcacgcagaacagaacacagggttcgatttatggacttttcaaaacgagaatttcagtgggagactgtggcaaatgacacagtgttgacactggaattttgactacatgttggtctagaccccagttgaaattaaacagctcttttaataaaagctctttggctttcctcactgttccaaatcccacagcccccttctccttcttcctttttgagcaggatgggattacaggtcggaatgtacggattgtttcattttggggtaatgatggatcagccacagccaagccttacccgtgctgacgaatctccatgtgatcgtgtcctttctccatgtgctgcccacagaaagcagcgagactgctgtctcagctggaaagctgagcctgagagatttctggttaaaaaaaaataaaaaataaaaatctcctgcctaaggaaataaa

SEQ ID NO: 185012 - DNA, 540 bp, Homo sapiens
  Payload ID: 16425
  Gene Symbol: SNX29
  Gene Name: sorting nexin 29
  ENST ID: ENST00000569801
  CDS Start-End: 71-361
tggagctcggcagccgcagaagcggcagcggcggcggcgcggcgcaggcaccggcccggggagaggcaccatgagcggatcacagaacaatgacaaaagacaatttctgctggagcgactgctggatgcagtgaaacagtgccagatccgctttggagggagaaaggagattgcctcggattccgacagcagggtcacctgtctgtgtgcccagtttgaagccgtcctgcagcatggcttgaagaggagtcgaggattggcactcacagcggcagcgatcaagcaggcagcgggctttgccagcaaaaccgaaacagatggagcctcactctgttgcccagtctggagtgcagtggcatgatctcagctcactgcaacctctgcctcccaggtgcaagtgattctccagcctcagccacctgagtagctgggactatagagcccgtgttctggtactacgtgaaggaggtcctcaacaagcacgagctgcagcgcttctactccctgcgccacatcgcctcagacgtgggccggggtcgc

SEQ ID NO: 185013 - DNA, 1755 bp, Homo sapiens
  Payload ID: 16426
  Gene Symbol: SNX3
  Gene Name: sorting nexin 3
  Uniprot ID: O60493
  ENST ID: ENST00000230085
  CDS Start-End: 340-828
agtccggccggaacctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgcactgattgtgttgcctccagctttttttgctctctatgagtgactacttaagtcacttgttgagagggattatttactaattatatacttctcattcctgtaactccattccctttaaacagtggtgatatcaaatatacttccatccattgaatggggtatttttaacaacaacaaaagtgatatactaaaaaatgtattgcttaaggcttattgaatcattttgaagcactttgtgtatttgaaaactgctttataatctcatttattaaaaggactttcaaagataaaa

SEQ ID NO: 185014 - DNA, 890 bp, Homo sapiens
  Payload ID: 16426
  Gene Symbol: SNX3
  Gene Name: sorting nexin 3
  Uniprot ID: O60493
  ENST ID: ENST00000349379
  CDS Start-End: 324-746
gtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttt

SEQ ID NO: 185015 - DNA, 1537 bp, Homo sapiens
  Payload ID: 16426
  Gene Symbol: SNX3
  Gene Name: sorting nexin 3
  Uniprot ID: O60493
  ENST ID: ENST00000368979
  CDS Start-End: 326-667
ctgtttgcgaccccgagtcccatgacaccgcttctcctcacaccccagtccgcagtgcccctccccagcctcggccgggcctcccgggagccgggcgtggcgttccagctagtgagccgtttctcccctgggctcggaggcggaagcttgaggggcgcggggaggagcttcgcgtgcggggtgaacgcccgctctacgtgctcgttctcttcgcgaccgctgcgcgcgagccccgtgtccccacggcgggcagcagcggcggcggcggcggctgaacgcggagggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaagccctgcctcagaatgacatcagaggcaaggagtcatggaaggacgtggtgtgctcagaatgatgaaaagttattttgtgactagaaagtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgca

SEQ ID NO: 185016 - DNA, 1072 bp, Homo sapiens
  Payload ID: 16426
  Gene Symbol: SNX3
  Gene Name: sorting nexin 3
  Uniprot ID: O60493
  ENST ID: ENST00000426155
  CDS Start-End: 44-436
gggggcggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgca

SEQ ID NO: 185017 - DNA, 2457 bp, Homo sapiens
  Payload ID: 16427
  Gene Symbol: SNX31
  Gene Name: sorting nexin 31
  Uniprot ID: Q8N9S9
  ENST ID: ENST00000311812
  CDS Start-End: 152-1474
agatgtccccggccggcgagagcgggcgccggggttcgctctgagtcgcgtggcaggccgcgctgcgtccaccgctgccgagttcagagccgcgcaccgcccgccgccgcaggtcgggttcccagcgctactcccaagacaccgctcagccatgaagatgcatttctgtatcccggtgtcccagcagcggtccgacgcgctggggggccgctacgtgctgtactccgtgcacctggacgggttcctcttctgcagggtgcgctacagccagctgcacggttggaacgaacagctaaggcgggtctttggaaattgcctgccacccttcccaccaaagtactatctggcaatgaccacagctatggctgatgagaggagggaccaactggaacaatatttgcaaaatgtaaccatggacccaaacgtgttgagaagtgatgtcttcgttgagtttttaaaactggcgcagctgaatacatttgacatcgccaccaagaaagcttatctggacatatttctgcccaatgaacagagtattagaatcgaaattataacatcagacactgctgaaagagtcctagaggtggtgtcacacaaaattggactgtgtcgagagctcttgggctacttcggcctctttctcattcggtttggcaaggagggcaagctctctgttgtgaaaaaattggctgactttgaactcccttatgttagtcttggaagttctgaggtggaaaactgtaaggttggactccgaaagtggtatatggctccatccctcgactccgtgctgatggactgcagggtggcggtagatttgctctacatgcaggcaatacaggacattgaaaaaggatgggccaaacccacacaggcacagaggcagaaattagaagctttccagaaagaagacagtcaaacaaagtttttggagctggcccgggaggtacggcactatggatacctgcagctggatccttgtacctgtgactacccagaatcaggctctggagctgttctttctgttggcaataatgagatcagctgctgcatcaccctgcctgacagccagacccaggacatcgttttccagatgagcagggtgaagtgctggcaggtcactttccttggaactctgctggatacggatgggccccagagaactctcaaccagaacttagagctcagatttcaatacagtgaggatagttgctggcagtggtttgttatttacaccaaacaggcttttttgctgagtagctgcttgaaaaagatgatctcagaaaagatggtaaagctagctgctgagaatacagaaatgcagattgaagttccggaacaaagcaaaagtaaaaaataccacattcaacaaagccagcagaaagactattctagttttctatcaagaaaaagcaagattaagatagctaaagatgactgcgtttttgggaacataaaggaagaagatctctgaagaaagctctcatattttaaaatatccttggaggctatctcaagacagtgaaagaacttggggattcaggtgggctacctaccatcagtggaggaaatttgacctcttcccatttttttggcattaacatggactgtattcatcaaggtattataccacagcactctatggaaatctcaagattagaaaaaaaaaaagaaccaagttatagagttagtttttattttatttttgcacttcgtcatgacagtatagagtttgtttttaatgtctcataaatgacaagtggcaaattcaaatcaactcatataaaactcattctattttttctctaaaatagatctttatatggcttcatgaagtcttttatgtgttttgaatttacataaatgaaagtctcataaaatatcataaagatattttggatcgatttctaaagatgtgactcttcaacggaggagaatagggctctgagaaatggaatcactgaaaaagaaacctgggttctctgatctatccacacagaactagagcaaggaggtgatgaaatactgatctctttcctcacataagtctgagcctaccaatatggatgtactcaaagtgaaacgctgccctgttctctgcttgaccattgttataattttattctgtccttagagtactgaaggcagttcaataatcaacatgctatttggaatgttttaatttggaaagcaataaggctctgcacctgatatcagataccttataattctcttagctttaaaaatatgtatactttctcacaaggtttttccttatctagcttcatttctctcatggtaattaatgtaattatgtatagaattaagaccacaataagggagatgatcagaggaatctgtatagtgtaattagaaaaagtacaatattctaatgttctaactgggttgtatacctaattatataataaatacaaaataattccagtgaatataaaa

SEQ ID NO: 185018 - DNA, 1265 bp, Homo sapiens
  Payload ID: 16427
  Gene Symbol: SNX31
  Gene Name: sorting nexin 31
  Uniprot ID: Q8N9S9
  ENST ID: ENST00000428383
  CDS Start-End: 40-1065
aattagtgtcagaaaaaatcagggatatgggctttagggatgcttggaaatactgaaaactggaatacatttgacatcgccaccaagaaagcttatctggacatatttctgcccaatgaacagagtattagaatcgaaattataacatcagacactgctgaaagagtcctagaggtggtgtcacacaaaattggactgtgtcgagagctcttgggctacttcggcctctttctcattcggtttggcaaggagggcaagctctctgttgtgaaaaaattggctgactttgaactcccttatgttagtcttggaagttctgaggtggaaaactgtaaggttggactccgaaagtggtatatggctccatccctcgactccgtgctgatggactgcagggtggcggtagatttgctctacatgcaggcaatacaggacattgaaaaaggatgggccaaacccacacaggcacagaggcagaaattagaagctttccagaaagaagacagtcaaacaaagtttttggagctggcccgggaggtacggcactatggatacctgcagctggatccttgtacctgtgactacccagaatcaggctctggagctgttctttctgttggcaataatgagatcagctgctgcatcaccctgcctgacagccagacccaggacatcgttttccagatgagcagggtgaagtgctggcaggtcactttccttggaactctgctggatacggatgggccccagagaactctcaaccagaacttagagctcagatttcaatacagtgaggatagttgctggcagtggtttgttatttacaccaaacaggcttttttgctgagtagctgcttgaaaaagatgatctcagaaaagatggtaaagctagctgctgagaatacagaaatgcagattgaagttccggaacaaagcaaaagtaaaaaataccacattcaacaaagccagcagaaagactattctagttttctatcaagaaaaagcaagattaagatagctaaagatgactgcgtttttgggaacataaaggaagaagatctctgaagaaagctctcatattttaaaatatccttggaggctatctcaagacagtgaaagaacttggggattcaggtgggctacctaccatcagtggaggaaatttgacctcttcccatttttttggcattaacatggactgtattcatcaaggtattataccacagcactctatggaaatctcaagattagaaaaaaaaaaagaa

SEQ ID NO: 185019 - DNA, 705 bp, Homo sapiens
  Payload ID: 16427
  Gene Symbol: SNX31
  Gene Name: sorting nexin 31
  ENST ID: ENST00000520352
  CDS Start-End: 332-705
ctcaaaagccctgtgcattcaaaaaaggcttggttgggttatttccagttgtactgtcgagaaaagagctatttctgtcttttaactctcaaatacaaagatactgctcagtgggaatcaaacattcctaattttcatttatttatcttttcattttaattttggattggggggggtatctgcgcagctctgttagacggagtatattgcatggtgctgaggtctgggcttctgatggtcccgtcgttcaagtagcaaacgcgctgcgcgaaagctaaggcgggtctttggaaattgcctgccacccttcccaccaaagtactatctggcaatgaccacagctatggctgatgagaggagggaccaactggaacaatatttgcaaaatgtaaccatggacccaaacgtgttgagaagtgatgtcttcgttgagtttttaaaactggcgcagctgaatacatttgacatcgccaccaagaaagcttatctggacatatttctgcccaatgaacagagtattagaatcgaaattataacatcagacactgctgaaagagtcctagaggtggtgtcacacaaaattggactgtgtcgagagctcttgggctacttcggcctctttctcattcggtttggcaaggagggcaagctctctgttgtgaaaaaattggctgactttgaactcccttatgttagtcttggaag

SEQ ID NO: 185020 - DNA, 563 bp, Homo sapiens
  Payload ID: 16427
  Gene Symbol: SNX31
  Gene Name: sorting nexin 31
  ENST ID: ENST00000520743
  CDS Start-End: 263-563
gtgcattcaaaaaaggcttggttgggttatttccagttgtactgtcgagaaaagagctatttctgtcttttaactctcaaatacaaagatactgctcagtgggaatcaaacattcctaattttcatttatttatcttttcattttaattttggattggggggggtatctgcgcagctctgttagacggagtatattgcatggtgctgaggtctgggcttctgatggtcccgtcgttcaagtagcaaacgcgctgcgcgaaagatggagtctacctttgtcacccaggctggaatgcagtggggcgatcttggcttactgcaacctctgcctcccaggttcaagggattctcctgcctcagcctcccaagtagtccacttcattcttcacctctggaccttcaccagctgtactccgtgcacctggacgggttcctcttctgcagggtgcgctacagccagctgcacggttggaacgaacagctaaggcgggtctttggaaattgcctgccacccttcccaccaaagtactatctggcaatgaccacagctatggctgatgaga

SEQ ID NO: 185021 - DNA, 489 bp, Homo sapiens
  Payload ID: 16427
  Gene Symbol: SNX31
  Gene Name: sorting nexin 31
  ENST ID: ENST00000520661
  CDS Start-End: 79-489
acggagtatattgcatggtgctgaggtctgggcttctgatggtcccgtcgttcaagtagcaaacgcgctgcgcgaaagatggagtctacctttgtcacccaggctggaatgcagtggggcgatcttggcttactgcaacctctgcctcccaggttcaagggattctcctgcctcagcctcccaagtagtccacttcattcttcacctctggaccttcaccagctaaggcgggtctttggaaattgcctgccacccttcccaccaaagtactatctggcaatgaccacagctatggctgatgagaggagggaccaactggaacaatatttgcaaaatgtaaccatggacccaaacgtgttgagaagtgatgtcttcgttgagtttttaaaactggcgcagctgaatacatttgacatcgccaccaagaaagcttatctggacatatttctgcccaatgaacagagtattagaatcgaaattataacatca

SEQ ID NO: 185022 - DNA, 426 bp, Homo sapiens
  Payload ID: 16427
  Gene Symbol: SNX31
  Gene Name: sorting nexin 31
  ENST ID: ENST00000518342
  CDS Start-End: 1-146
agatgatctcagaaaagatggtaaagctagctgctgagaatacagaaatgcagaaagactattctagttttctatcaagaaaaagcaagattaagatagctaaagatgactgcgtttttgggaacataaaggaagaagatctctgaagaaagctctcatattttaaaatatccttggaggctatctcaagacagtgaaagaacttggggattcaggtgggctacctaccatcagtggaggaaatttgacctcttcccatttttttggcattaacatggactgtattcatcaaggtattataccacagcactctatggaaatctcaagattagaaaaaaaaaaagaaccaagttatagagttagtttttattttatttttgcacttcgtcatgacagtatagagtttgtttttaatgtctcataaat

SEQ ID NO: 185023 - DNA, 2003 bp, Homo sapiens
  Payload ID: 16428
  Gene Symbol: SNX32
  Gene Name: sorting nexin 32
  Uniprot ID: Q86XE0
  ENST ID: ENST00000308342
  CDS Start-End: 426-1637
gttggaaggaggggcccggaacggcggcacggggttgttgtgggggtcagtcccccggggactggagggagacgcggcacgcggcctctgcgaccctatgaactctgaccccagctcccacactgtcgcctatcaccggcccactctccgtgccgcgtgtcccttaaaagctggggcctgggacaggaacgacagacaatgcagccaatggcgtcacgcgcggtgccccgctacccaatcgaaaggcgtggctgagggaaacgcggtgggaaccgcccccgactccaggcgactccttggccgggcgggggagagcgtccccgtcagctgagagcatcctcactcggtcagttcctcgggcgagttacggggacgacctgcgggagcacgcgggcagtggccggacgctgaagcccaggagagcgatggagacgtatgcggaggttgggaaggagggcaagccttcctgtgcatcggtggatctgcagggagacagctccttacaggtggagatttctgacgcagtgagtgagcgggacaaggtgaaattcactgttcaaacaaagagctgcctccctcacttcgcccagaccgagttctcagtcgtgcggcagcacgaggagttcatctggctgcatgatgcctacgtggagaatgaggagtacgccggcctcatcatccccccagcccctccgaggccagactttgaggcttcgagggaaaagctacagaaattgggcgagggggacagctctgtcactcgggaagagtttgccaagatgaagcaggagctggaagcggagtacctggccatctttaagaagacagttgcgatgcacgaagtctttctgcagcgcctggcggcccaccccaccctgcgtcgagaccacaacttctttgtgtttttggaatatggacaggatctgagtgtccgggggaagaacaggaaggagctcctcggagggtttctgaggaatattgtgaagtccgcggatgaagccctcatcacgggcatgtcagggctcaaggaggtggatgacttctttgagcatgagaggaccttcctgttggagtatcacacccgtatccgagatgcctgcctgcgggccgaccgcgtcatgcgcgcccacaagtgcctggcagacgattatatccctatctcagctgcgctgagcagtctgggaacacaggaagtcaaccagctaaggacgagcttcctcaaattggcagagctctttgaacggctgaggaagctggagggccgggtggcttccgatgaggacctgaagctgtcagacatgctgaggtactacatgcgtgactcacaggcagccaaggacctgctgtaccggcggctgcgggcactggccgactacgagaatgccaacaaggcgctggacaaggcgcgcaccaggaaccgggaggtgcggcccgccgagagccaccagcagctgtgctgccaacgcttcgagcgcctctccgactccgccaagcaagagctcatggacttcaagtcccgccgggtctcctcttttcgaaagaatctcattgagctggcagagctggagctcaaacacgccaaggccagcaccctgattctccggaacacccttgttgccctaaagggggagccttagagtagccagagctcagccagaccctaatctgggatctccagtgaccagggtatcccagacccctctctccggcaagatgtctccttccctagcagtgccactagccacaccctcactctgccccacatcctctcagggaaagcccaaaccccctatcaccaccaccacaggtgccaggccctgcaagacacagggcagcatgggcatcataactggccacagtcagcagagccccagggaccctgacacctctccccaggaagctgaggaacagcctctaccctcacccatagccctgaaggaatcatagctcacttgatcccggcctgttctccttcgcaaataaaaaccctggttttgtagcaa

SEQ ID NO: 185024 - DNA, 8008 bp, Homo sapiens
  Payload ID: 16429
  Gene Symbol: SNX33
  Gene Name: sorting nexin 33
  Uniprot ID: Q8WV41
  ENST ID: ENST00000308527
  CDS Start-End: 1198-2922
ggaatcgcctttttgttttggagctgccttctcgctggcggagcggagggtctgcgagcgccggggaaggcaggctgggggcgcagcccgccccccactggccgggccccgcagggcggagaggaggacggacggacagacggctggccgcgccatctgctcgccggagctcactctccaaactccaaactgttgagtgtgtgcgtgcacgcgagggtggtgatcgggggtcgtaagtcccgggtgaggaaccggtttctgctggggttacctttggacggggttcctgggattcagagcagggtcagcgtcaggctcagaaactgctgaggaattaggcaaacaaaagagaccactcagcgagtggctagaagtcgcccgacagcctcgtcgcgccccctccttcctccggggttggggctggccacttctggggcggggagagggcgcccgagccggcgggggctccggctgcgcagccggggtcgaagagttggcggcctgttgtgtaagcctcagtccttgttttcccggcctggctcgttgtgaagccggacacatccacccttggactcgattcaggcggctgctgcttttctccttgcccctcttggattttccggatttttgaaaacccagtggcccaggagcaagaggaggaaggaggaaggggcagatctgcagaggaatgtgagagcctcccaaagcgagagccgccaaaagaatctgggagccagagggacagccgagccctgcccgggtttctggaatggtggtttcagagtgagtctcttctattttagaacgttgttccagtggaaagtgtcgaatttttcccctcgcagggcagatttctccaggtcacttgacttttcttctgggagtaggagttaggagagattcccctctaaccccccagaggctgctaagggaggaggagactgtggacatgagccctccctgctcacaagcatatgcccggagacctgatagggcagtttctgggccatggacattgctttgaagagggggagactggacagcatctgtgggtgctgagaccccaccttaggacctgagagattgaactgtgtaagcgccattcagctgcgagtgcattcttggactgccttgtgagcatccccggtctgggcaggaccctctccttcccatctttctataccacccagcccagccatggcactgaaaggccgagccctctatgactttcacagtgagaacaaggaggaaatcagcatccagcaggatgaggacctggtcatctttagcgagacctcactggatggctggctgcagggccagaacagccgtggggagacagggctctttcctgcctcttatgtggagatcgtccgttctggcatcagcaccaaccatgctgactactccagcagccctgcaggctctcccggagcccaggtgagcttgtacaacagccccagtgtggccagcccagctaggagtggtgggggcagtggcttcctctcaaaccagggtagctttgaggaggatgatgatgatgactgggatgactgggacgacggatgcacagtggtggaggagccacgggctggtgggctgggcaccaacgggcaccctcccctcaacctctcctaccctggtgcctaccccagccagcacatggccttccggcccaagccaccactggagcggcaggacagcctggcatctgccaagcgaggcagtgtggtgggccgtaacctcaaccgtttctcatgctttgtgcgttctggagtggaggccttcatcctgggtgatgtgcccatgatggccaagatcgctgagacatactccattgaaatgggccctcgtggcccccagtggaaggccaatccccacccatttgcctgctctgtggaggaccccacaaaacagaccaaattcaagggcatcaaaagctacatctcctacaagctcacacccacccatgctgcctcacccgtctaccggcgctacaaacactttgactggctctataaccgcctgctacacaagttcactgtcatctcggtgccccacctgcctgagaagcaggccactggccgcttcgaggaggacttcatcgaaaagcggaagcggagactcatcctctggatggaccacatgaccagccaccctgtgctctcccagtacgaaggcttccagcatttcctcagctgcctggatgacaagcagtggaagatgggcaaacgccgggcggagaaggatgagatggtgggtgccagcttcctgctcaccttccagatccccaccgagcaccaggacttgcaggacgtggaagatcgcgtggacactttcaaggccttcagtaagaagatggacgacagcgtcctgcagctcagcactgtggcatcagagctggtgcgtaaacatgtggggggcttccgcaaggaattccagaagctgggcagtgccttccaggccatcagtcattccttccagatggacccccccttttgctctgaggccctcaacagtgccatttctcacacgggccgtacctatgaagccatcggggagatgtttgctgagcagcccaagaatgacctcttccagatgctggacacactgtctctctaccagggcctgctctccaacttccctgacatcatccatctacaaaaaggcgccttcgccaaggtgaaggagagccaacgcatgagtgacgagggccgcatggtgcaggacgaggcagacggcattcgcaggcgctgccgcgtggtgggtttcgccctgcaggccgagatgaaccacttccaccagcgccgtgagctcgacttcaagcacatgatgcagaactacttgcgccagcagatcctcttctaccagcgggtgggccagcagctggagaagaccctgcgcatgtatgacaacctctgaccgcgtgtgcctgggccccctccttcccctgggcctggtcactgcagtgtaccccactttcccgacctccctataccagcagtgactgggggaggggtcagcggtgggggagataagcggcctgtcctgcctcctgggagaaggagctttcaaggagtcatgggtgcccctgggaaattccccactccttagaagtggggcacagcaggggtgagaatagagtcaggagccctcgaggccaaggcctgggctgccggtcagtcagtgaaggtcaggccagggtctcagcctcccctagagcctattttgcttgctcacctggccactgctgccttatccattcagcagacaccgaggcctgctgcacccttgggtcggatgctgggcacccagggctgtgacatgcctgctcttcaggagtcctcagtgaaggtcggggtcagacacagacagagtcaatgcagtatgactgatgtttaagtgagggatttctggaagctcatagaagggaccacagcattccactggtcagggaagactccatagagtaggcaacatttgggcagtgttttgaagaatgacaagggcctgccagacagtacatgggggagaaggactttcaggggagaggaacagcatgggcaaagttatggaggcatgcaaacatctccctcttctctcccttactttccaagcaagttaggtacgctttccatggggattctggcctgtgtggtaggaagggatctcccttgctcccatgttgctggctgtccgtacatcaccctgtcccctgcaggagggggctacaggccatctccctcctgtaggcctctgactcccctccacttttgggccctcagcttatctcgggcaggggaccattgcagcatcctcccctcctcggactcaaggtgctgaggtataagccctgggccccagatccctggtgacaccttcctggagaagactctcaaaagtgactgtatatttgagttcaccagcaataactccccacactcgaagcaggtccaaacccaggatctcagggtccttgggctctgtggcactgtcttcccaagatccttcctgttgcacaatgggaaacctaagaggaaaaagacaggggcctgcttgcccagccatgcgagggattccatgcccacctgccctctgtctgcctcgctggaatgtgggcccctgctccccgtcaggttgtgctgtctctgacctatgtttacatccccgaggggtttctgcctcctccccacccaggtcagggtgtggtccagcagcttgctgtggggtgctgacatgtgtcaccactgccccccttgcccccgggggggtcatggtctcctcctggatgctgctccttgaatcttttttcttgataaaccttttacaattaagataacacaagcatgactttttctgtttggatcccagaaaggcggagggcaggagaaggatagagccctaattgctcctgagagccattggatgagattctgaggtcgtggtgggcacaaattttccacagaacctcaaaagttcaggggagggctatgctggtggaaggtgccagcaggcaggaggagctagaggcggctgtggacccctgggtggatccatccctccctagaacgcactcttgtctctaaaacaggtggagtgctgcccaggggactggctgtactgccttgtgatctggggctgagggttgtatgaggaagggacaggacgctgtgccctaggacaattaatagatggtggctcctctccccaaggagccatgccctggccttgcccttgaaaagccctagtccaggggagggaagtgggggactcagaagctgtgtctcttccccaaaccgtcctgggtacccagccctgcggaggctcccacattggaaactgaagaggacgctggctgttgggggtgccctgatcaggatgagcggaccttgctcttggatctgttcatccacagatgagaggagggtactggttgagacttggctctcctttggaggcaatggggacttggtggagggagggcttccagggtcaaggccgtcagggaaggttggctagaccagggaccagggagcttgtgcaggaagatggagaagggccagcaggtgcggtgggggaaggggcgggcaggactccctgttcagggcatagcgtcctcagaggaacttctggaatgggtccccctggcccttggtcaacattaggtcagatttgggactttctgaggaattttcccctctctccaccctgccccattttctaacccatccgaggaacttcccgcccttaacctcttctcagctctgccatccatgtagccatctgcagaaggggctctgagcagtgggggctgggccaggccgaggcagggctggtgggaatgctcctcctaacccatggtgcctggaaagtcccctgctcatgcttcctgctctgggaacagtgttgtcctctgtgtgccttccttgagaggggaccacctcccaggccttccatcctcagggtgaggccatcagtctgatacttttctcaggagggacttggatccaggagaagcatcaggaagtggagtcttgggataatgccaggcctgctcctggtatcctgaggtctctgggctggggcaggtgtgtgtgtggcagggagggaggctgtcctggccctcctctctcttttctttctgcctctatgggggtgggggtattgggggaacttggggccgttctggggtagctaagcccctttcagcaggagattgggggaccagtgttgggggcatcctggtgatggccgattcctgcctcgtcacatgccaggcagatgttcccgactcggctggacccagctgcctcgtttcctcccttactttgctctgagggggtggaaaacaaggcttctctttctgccctggacagctaccagcacccggggtaggggatcccctggtcaccagtcttggcccagtacaggaaaaggaatccgctttgtggccacagatgggggctggggatggaagcagacctcagatcctgcatctcttcacccgctggacacaggagggctatgaaccactgtgccgtggctgcaccactggctggagcagagccaggcctgggagaggcaggtggccccatcggcccctgctctgcaccacccctcccagatgacagagccatatgtcttccacgtgtctacacactcacagactcacgaatgtaatcgctcagtctcacaacaagcacacgcagtcacacacctgcccacaggcacatacgccacataagcatgcctgtatgctcacacagtcatactgccacacgctattacacattcacagccacagccacacatgccttgccatccattcaaagcaccagtggctactttgtcagacacagccacaccacagtcctatgcacatggtcatagcctcacacagtgacacatactcgggcacacaccgccacaaagccatgcttgcacagagcaaaggtgtcataagcatctctgtgcctggactgcacctgcatgacctcccagggtccccacctcatcagagattaaggagagctttgcttggagacaccacccctggagggggtgtctccaagggggagtagagccagtcacaagcaccacatacaggcacacagcctgaggtctagggatgcaattgggatgactggataccaccaagttcagctccttattgaacagatgggcgcctgaggcccagggagcagtggtggctggccttatcacccagcagggcaggggatactctggggccagagcctggctctgggcagactctgtttcctggccctgccctcccctgggccaatcctctgggccaggctgcctctgaaggcccctggctgaaccgatccagcagagctccaggcagctcccttctcaagctagagctgagctgcagtggccacgggagccggagccaggatgcggtgggcagggcctaggcctgggcgggaggaacattcctgcaccatctcctccccaagcatgtgaggacccagcccgccctgcccgcctgcccgctgactcaggcctccaggagccaagcctgctcagctcccccacccaccctaacctgcttccccactagttcggctctggttcccctctccactggctggggcaggagaagacggtgagccctggtaggaagaccatggggaaaaatcaaacctcaccaccccccgacatagctcagaagggctgattgtgaaacccagctctgttcaacatagttgaacacaaactttttttttcttttggtttggttttgttttgttggtcaaaccccagtgcagtgcagtctgtttaagaagtagtgtcgcatagctgtggcctggatctgctcagcagccccagtaggcagcatttattccctttcgcaacaaagagactgagacttggccagagggaagatgggacctgcctaggttcacacagggaatctctggcggggctggactcaaacccagctccctgccatcactccttagagtcacactgatgaactcatttagggccaaaggaagaaggggaggcagatttcccctctagatgagtgaagggataggaggctggtgaacccaacggctgaaatgtgaagggtgagagggtagggtgagtccccccagccctgagggatgaagggtctgaagatggcactgcacggtgacagctgcagtgactcaggagctccgtttacaaaggaacatgagtgaggaacataacttaatttttttttatatctgacctgaatttctgttttcctcccccattccccacatggtagaagtgtaatctcacatcaatttggggaccctttctttccccagggatgtgtagaacttttggggatggcacatttgaagaccttagggagctttgcattttaaaggctgaatcccacactctatcatacatattaatatttacctgcattccacattaaagggttcagtttatgacttgtgtcctgtcttgtagatacttaattaaacggtattaattttga

SEQ ID NO: 185025 - DNA, 2265 bp, Homo sapiens
  Payload ID: 16429
  Gene Symbol: SNX33
  Gene Name: sorting nexin 33
  ENST ID: ENST00000569152
  CDS Start-End: 1-850
tcgtggcccccagtggaaggccaatccccacccatttgcctgctctgtggaggaccccacaaaacagaccaaattcaagggcatcaaaagctacatctcctacaagctcacacccacccatgctgcctcacccgtctaccggcgctacaaacactttgactggctctataaccgcctgctacacaagttcactgtcatctcggtgccccacctgcctgagaagcaggccactggccgcttcgaggaggacttcatcgaaaagcggaagcggagactcatcctctggatggaccacatgaccagccaccctgtgctctcccagtacgaaggcttccagcatttcctcagctgcctggatgacaagcagtggaagatgggcaaacgccgggcggagaaggatgagatggtgggtgccagcttcctgctcaccttccagatccccaccgagcaccaggacttgcaggacgtggaagatcgcgtggacactttcaaggccttcagtaagaagatggacgacagcgtcctgcagctcagcactgtggcatcagagctgggcctgctctccaacttccctgacatcatccatctacaaaaaggcgccttcgccaaggtgaaggagagccaacgcatgagtgacgagggccgcatggtgcaggacgaggcagacggcattcgcaggcgctgccgcgtggtgggtttcgccctgcaggccgagatgaaccacttccaccagcgccgtgagctcgacttcaagcacatgatgcagaactacttgcgccagcagatcctcttctaccagcgggtgggccagcagctggagaagaccctgcgcatgtatgacaacctctgaccgcgtgtgcctgggccccctccttcccctgggcctggtcactgcagtgtaccccactttcccgacctccctataccagcagtgactgggggaggggtcagcggtgggggagataagcggcctgtcctgcctcctgggagaaggagctttcaaggagtcatgggtgcccctgggaaattccccactccttagaagtggggcacagcaggggtgagaatagagtcaggagccctcgaggccaaggcctgggctgccggtcagtcagtgaaggtcaggccagggtctcagcctcccctagagcctattttgcttgctcacctggccactgctgccttatccattcagcagacaccgaggcctgctgcacccttgggtcggatgctgggcacccagggctgtgacatgcctgctcttcaggagtcctcagtgaaggtcggggtcagacacagacagagtcaatgcagtatgactgatgtttaagtgagggatttctggaagctcatagaagggaccacagcattccactggtcagggaagactccatagagtaggcaacatttgggcagtgttttgaagaatgacaagggcctgccagacagtacatgggggagaaggactttcaggggagaggaacagcatgggcaaagttatggaggcatgcaaacatctccctcttctctcccttactttccaagcaagttaggtacgctttccatggggattctggcctgtgtggtaggaagggatctcccttgctcccatgttgctggctgtccgtacatcaccctgtcccctgcaggagggggctacaggccatctccctcctgtaggcctctgactcccctccacttttgggccctcagcttatctcgggcaggggaccattgcagcatcctcccctcctcggactcaaggtgctgaggtataagccctgggccccagatccctggtgacaccttcctggagaagactctcaaaagtgactgtatatttgagttcaccagcaataactccccacactcgaagcaggtccaaacccaggatctcagggtccttgggctctgtggcactgtcttcccaagatccttcctgttgcacaatgggaaacctaagaggaaaaagacaggggcctgcttgcccagccatgcgagggattccatgcccacctgccctctgtctgcctcgctggaatgtgggcccctgctccccgtcaggttgtgctgtctctgacctatgtttacatccccgaggggtttctgcctcctccccacccaggtcagggtgtggtccagcagcttgctgtggggtgctgacatgtgtcaccactgccccccttgcccccgggggggtcatggtctcctcctggatgctgctccttgaatcttttttcttgataaaccttttacaattaagat

SEQ ID NO: 185026 - DNA, 2513 bp, Homo sapiens
  Payload ID: 16430
  Gene Symbol: SNX4
  Gene Name: sorting nexin 4
  Uniprot ID: O95219
  ENST ID: ENST00000251775
  CDS Start-End: 26-1378
gggttcgccgcgccgaactgcagccatggagcaggcacctccggaccccgagcggcagctccagccggcgcccttggagccgctgggctccccagacgctgggctgggggctgcggtcggcaaggaagcggagggggccggagaagagagctctggggtcgacacgatgacacacaataatttttggttgaagaagatagaaatcagtgtttcagaagcagaaaaacgaactggaagaaatgccatgaacatgcaagaaacatatactgcttacctcattgaaacaaggtcagttgaacataccgatggtcagagtgtcctaacagactcactatggcggcgatatagtgaatttgagttgttgagaagctaccttttagtttactatccacatattgttgtgccacctctgccagaaaaacgggcagaatttgtttggcataaactctctgctgacaacatggatccagattttgtggagaggcgacggattggtttagaaaactttctcttgaggattgcttcacatcccatcctttgtagagacaaaatcttctatctgtttttaacacaggaaggtaactggaaggagactgtgaatgaaactgggtttcagctgaaggcagactccaggttaaaagcgcttaatgcaacattcagagtgaaaaacccagacaagagatttactgaccttaagcactatagtgatgaactgcagtctgtcatctcacatcttcttcgagtcagagctagagtagcagatcgactctatggtgtatataaagtacatgggaattatggtcgagttttcagtgaatggagtgccatagaaaaagaaatgggtgatggactgcagagtgctggtcatcatatggatgtgtatgcatcttctattgatgatattttggaagatgaagaacattatgcagatcagttaaaagagtatcttttttatgcagaagcattgcgggctgtgtgcaggaaacatgaacttatgcagtatgacttggagatggctgctcaggacttagcatccaagaagcagcagtgtgaggaactggtaactgggactgtgagaacattctctttgaagggaatgactaccaagctctttggtcaagaaactccagagcagagagaagccagaataaaggtgctagaagaacaaataaatgaaggagaacaacagctaaagtctaaaaatctggaaggcagagaatttgtgaaaaacgcatgggctgatattgaacgcttcaaagaacaaaagaaccgagacttaaaggaggccctcataagctatgcagtcatgcagatcagtatgtgcaaaaagggaattcaagtttggaccaatgctaaggaatgctttagcaagatgtaatcctgtgaattgaatttctcttcaatcaaagtgccccaaaacagaagcacaagtaaataaaagaaatttaagtcactacctagtatacataaacatatacaataagttaaataaattcagctttctttaacttaattgtggtcgtgttaatgtagcacaaaaaatatattttaatgaagattaaatattataatttgaggttttggggactggtgctgattccaaaaagttaatttaataatatataccaacagattgtttgtcacgcttctgaaccaatgactgaatgtcaagatgttcgttaatttctagatgtttgtttcaagaccagctgtttcagatctattaatgtagggaatttttccctaagattgaattcctatatttacttggtaagatccactaatctgttatagggagttgttttctcttgccttatagttgagctatttggtttgacaaagctcagcagaaacttgatgtgaaaaatctacgattttcttctacattcattgatgccccttgtaatgtttgcatacactagaaaatgccttcaatttgtgttttaccagaattttgatactggtcagaaattttatactgccaacaaagaagactcaacttctcagatctataatgggatacattgtcatcctctagcaactcctatatagaaagttttaactgaatatgttacatataagaattaaattcttctcaaataattcttaacctcagtaatgagcctaaatttactctgcttggctctctacacatggcatttcagggtataagatgtagcatttcaatgtgtaagatatatgtactaaacatatgtgttgctatcttcatcattaacatccttcttttctattgcttggctgtaatttttgtaaagataaattatattgtttttttgtatgtgtgtttgtagtatatgttcagaaggcaagcatcttcattttgctagctttgcagaatcttaaaatgtgtactcgttatttctaatgatgtaaaaaaaaatccctagtcctgtttagcatttgacttttttatatgttttaaatgttgctggatttttgtgctgtttgccaaacttatacaataaataaatgaaatattgtgctgattttca

SEQ ID NO: 185027 - DNA, 591 bp, Homo sapiens
  Payload ID: 16430
  Gene Symbol: SNX4
  Gene Name: sorting nexin 4
  ENST ID: ENST00000465505
  CDS Start-End: 1-468
atgacacacaataatttttggttgaagaagatagaaatcagtgtttcagaagcagaaaaacgaactggaagaaatgccatgaacatgcaagaaacatatactgcttacctcattgaaacaaggtcagttgaacataccgatggtcagagtgtcctaacagactcactatggcggcgatatagtgaatttgagttgttgagaagctaccttttagtttactatccacatattgttgtgccacctctgccagaaaaacgggcagaatttgtttggcataaactctctgctgacaacatggatccagattttgtggagaggcgacggattggtttagaaaactttctcttgaggattgcttcacatcccatcctttgtagagacaaaatcttctatctgtttttaacacaggaaggtaactggaaggagactgtgaatgaaactgggtttcagctgaaggagatttactgaccttaagcactatagtgatgaactgcagtctgtcatctcacatcttcttcgagtcagagctagagtagcagatcgactctatggtgtatataaagtacatgggaattatggtcgagttttcag

SEQ ID NO: 185028 - DNA, 1308 bp, Homo sapiens
  Payload ID: 16430
  Gene Symbol: SNX4
  Gene Name: sorting nexin 4
  ENST ID: ENST00000471751
  CDS Start-End: 10-159
actgcagccatggagcaggcacctccggaccccgagcggcagctccagccggcgcccttggagccgctgggctccccagacgctgggctgggggctgcggtcggcaaggaagcggagggggccggagaagagagctctggggtcgacacggtcagttgaacataccgatggtcagagtgtcctaacagactcactatggcggcgatatagtgaatttgagttgttgagaagctaccttttagtttactatccacatattgttgtgccacctctgccagaaaaacgggcagaatttgtttggcataaactctctgctgacaacatggatccagattttgtggagaggcgacggattggtttagaaaactttctcttgaggattgcttcacatcccatcctttgtagagacaaaatcttctatctgtttttaacacaggaaggtaactggaaggagactgtgaatgaaactgggtttcagctgaaggcagactccaggttaaaagcgcttaatgcaacattcagagtgaaaaacccagacaagagatttactgaccttaagcactatagtgatgaactgcagtctgtcatctcacatcttcttcgagtcagagctagagtagcagatcgactctatggtgtatataaagtacatgggaattatggtcgagttttcagtgaatggagtgccatagaaaaagaaatgggtgatggactgcagagtgctggtcatcatatggatgtgtatgcatcttctattgatgatattttggaagatgaagaacattatgcagatcagttaaaagagtatcttttttatgcagaagcattgcgggctgtgtgcaggaaacatgaacttatgcagtatgacttggagatggctgctcaggacttagcatccaagaagcagcagtgtgaggaactggtaactgggactgtgagaacattctctttgaagggaatgactaccaagctctttggtcaagaaactccagagcagagagaagccagaataaaggtgctagaagaacaaataaatgaaggagaacaacagctaaagtctaaaaatctggaaggcagagaatttgtgaaaaacgcatgggctgatattgaacgcttcaaagaacaaaagaaccgagacttaaaggaggccctcataagctatgcagtcatgcagatcagtatgtgcaaaaagggaattcaagtttggaccaatgctaaggaatgctttagcaagatgtaatcctgtgaattgaatttctcttcaatcaaagtgccccaaaacagaagcacaagtaaataaaagaaatt

SEQ ID NO: 185029 - DNA, 2270 bp, Homo sapiens
  Payload ID: 16431
  Gene Symbol: SNX5
  Gene Name: sorting nexin 5
  Uniprot ID: Q9Y5X3
  ENST ID: ENST00000377759
  CDS Start-End: 296-1510
tcctcgtggagcggagcaagggtaggccccacgtggcgtctttgcccggctccaagatggacggcagcggggactgggaggctgctctgggggagcacgtggcgccctgctcgcctgctcccggggcagctgggatggtggcggagtccggaggcctcctgccgccgtcgggcagggaggccggcggaggcggggccgtggccgcccccgagaggcgcccaggcggcggcggcggcggcccagcttcttctttcctcgcacagccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaatgt

SEQ ID NO: 185030 - DNA, 2288 bp, Homo sapiens
  Payload ID: 16431
  Gene Symbol: SNX5
  Gene Name: sorting nexin 5
  Uniprot ID: Q9Y5X3
  ENST ID: ENST00000377768
  CDS Start-End: 314-1528
ggcctccgccaacgcgccaccagttagaggcagggagtacctctccgagcggaagggccggcgtctccgaagcgcgggagcctccaaatcgcgcccttctgctctcacgagatctggtgacgtcagcgctcgctgccatcttggactcgggctgagtaataaattccccccgcaccgaaacgcggtctttctctagacgcgtcttgctgggagagtgtccgttgcttcccgtccgtgtcgcggccctgcggttggcggcctcctcgtggagcggagcaaggccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaagaactgataaatttcaaacggaagagagtggcagcatttagaaagaatctaattgaaatgtctgaactggaaataaaacatgccaggaacaatgtctcccttttgcagagctgtattgacttgttcaagaataactgatatgccttcactcagaagaaaagaaatgaatgtgaaagaaagccaagcatcacttgcacttaaatcattaccacggaagatatattagcttcaactttagtttaaaattatgtgaataaatattttgatttctacaaatcttaacatttaaccatgttggtttaaaaatattattgcttgctacttggacataactaatttttccttgtgcatttaatacctctgggcagaatccaaatactgggttctcccgtagttcgtctttagttactaagaaagggtgtaggacacattagccttctggaaacaagtagaagccatcacctggcccatgtccctacaaacccatgattgtcagggaggtgccagttacagcaggtgattcagctacttgaggtcggtaacagaccttccattcctcactgaaggtggggtttgtgtttttgttttgccctgttactccactggtagtcatctggtgtttgtactataacaacagcaagaaaatctcatttatctttatatactctttgcacctcctttttttagtcgagatataaatatttgaggggagagaaatatctacaggtatatatggaaacaaataatgtggtctgctttataagatggccagatctacattaggaaaagtataagccccctccctaatggccgctggggggtgagggcggtgtgttgtatgtctttgggtgtttgtttttttataaagcatataataaaataatcgtgctactaatgt

SEQ ID NO: 185031 - DNA, 840 bp, Homo sapiens
  Payload ID: 16431
  Gene Symbol: SNX5
  Gene Name: sorting nexin 5
  ENST ID: ENST00000431277
  CDS Start-End: 34-840
gccaggcggcccctgctcgagtcccgcgtcgccatggccgcggttcccgagttgctgcagcagcaggaggaggaccgcagcaagctgagatctgtatctgtggacctgaatgttgatccctcgcttcagattgacatacctgatgcgctcagtgagagagacaaagtcaaatttacagtgcacacaaagattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaag

SEQ ID NO: 185032 - DNA, 778 bp, Homo sapiens
  Payload ID: 16431
  Gene Symbol: SNX5
  Gene Name: sorting nexin 5
  ENST ID: ENST00000419004
  CDS Start-End: 87-778
gagaggcgcccaggcggcggcggcggcggcccagcttcttctttcctcgcacagccaggcggcccctgctcgagtcccgcgtcgccatggccgcggttcccgagttgctgcagcagcaggaggaggaccgcagcaagaccacactgcccacgtttcagagcccagagttttctgttacaaggcaacatgaagactttgtgtggctacatgacactcttattgaaacaacagactatgctgggcttattattccacctgctcctacgaagcccgactttgatggtcctcgagagaagatgcagaaactgggagaaggtgaagggtctatgaccaaagaagaatttgccaagatgaaacaagaactggaagctgagtatctcgctgtgtttaagaagactgtgtcctcccatgaagtctttcttcagcggctttcttctcaccctgttctcagtaaagatcgcaactttcatgttttcctggaatatgatcaggatctaagtgttaggcggaaaaatactaaagagatgtttggtggcttcttcaaaagtgtggtgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacct

SEQ ID NO: 185033 - DNA, 1087 bp, Homo sapiens
  Payload ID: 16431
  Gene Symbol: SNX5
  Gene Name: sorting nexin 5
  Uniprot ID: Q9Y5X3
  ENST ID: ENST00000606557
  CDS Start-End: 350-730
ctgggagagtgtccgttgcttcccgtccgtgtcgcggccctgcggttggcggcctcctcgtggagcggagcaagggtaggccccacgtggcgtctttgcccggctccaagatggacggcagcggggactgggaggctgctctgggggagcacgtggcgccctgctcgcctgctcccggggcagctgggatggtggcggagtccggaggcctcctgccgccgtcgggcagggaggccggcggaggcggggccgtggccgcccccgagaggcgcccaggcggcggcggcggcggcccagcttcttctttcctcgcacagccaggcggcccctgctcgagtcccgcgtcgccatggccgcggttcccgagttgctgcagcagcaggaggaggaccgcagcaaggtgaggtcctcccagcctcagactcctgggcgggcggccctgcgagctccggggtcgctgcattctttcccttgcgcgtccataggccgtggctgctcgccgccatccccagcgcgggaagcacccgtgagacccgggcggcccctctccctggtcttcactgaaggctgccccggggaatccctgtggatgtcccggattctattaggacagaaccagagacgcgggaccttagccccagctcaggcgccggtgccgagcggacttggagagatgatctctggagaccccggaatgttctttttaaaactttcctcggcttcgtggtgaccagtaggtgaacgtgaaattgacttaacatgcgacagaccagtttggtttgttgcccccaaaataccctccttccccccaccttttactgagaagacttttttggggggggggcccaaacaacttgggaaattgcatcaagcgtccgaacatgctgcttacaactttagaaacgcaaaatgcgttgttgtgggagttgtgtaatttttagtaggtgctcaaatacttgctgaacttggtgtctatttttaagtcttgcccattgatgtaaactgtccctaggtcacgtgtatcttgaggtctaaaagattatttatgcaataaattgaaattcccatagccaattaaagattcaga

SEQ ID NO: 185034 - DNA, 562 bp, Homo sapiens
  Payload ID: 16431
  Gene Symbol: SNX5
  Gene Name: sorting nexin 5
  ENST ID: ENST00000481323
  CDS Start-End: 141-236
ccgcaccgaaacgcggtctttctctagacgcgtcttgctgggagagtgtccgttgcttcccgtccgtgtcgcggccctgcggttggcggcctcctcgtggagcggagcaagggcggcccctgctcgagtcccgcgtcgccatggccgcggttcccgagttgctgcagcagcaggaggaggaccgcagcaaggccgtggctgctcgccgccatccccagcgcgggaagcacccgtgagacccgggcggcccctctccctggtcttcactgaaggctgccccggggaatccctgtggatgtcccggattctattaggacagaaccagagacgcgggaccttagccccagctcaggcgccggtgccgagcggacttggagagatgatctctggagaccccggaatgttctttttaaaactttcctcggcttcgtggtgaccagtaggtgaacgtgaaattgacttaacatgcgacagaccagtttggtttgttgcccccaaaataccctccttccccccaccttttactgagaagacttttttggggggggggcccaaacaactt

SEQ ID NO: 185035 - DNA, 602 bp, Homo sapiens
  Payload ID: 16431
  Gene Symbol: SNX5
  Gene Name: sorting nexin 5
  ENST ID: ENST00000486039
  CDS Start-End: 370-465
ctttctctagacgcgtcttgctgggagagtgtccgttgcttcccgtccgtgtcgcggccctgcggttggcggcctcctcgtggagcggagcaagggtaggccccacgtggcgtctttgcccggctccaagatggacggcagcggggactgggaggctgctctgggggagcacgtggcgccctgctcgcctgctcccggggcagctgggatggtggcggagtccggaggcctcctgccgccgtcgggcagggaggccggcggaggcggggccgtggccgcccccgagaggcgcccaggcggcggcggcggcggcccagcttcttctttcctcgcacagccaggcggcccctgctcgagtcccgcgtcgccatggccgcggttcccgagttgctgcagcagcaggaggaggaccgcagcaaggccgtggctgctcgccgccatccccagcgcgggaagcacccgtgagacccgggcggcccctctccctggtcttcactgaaggctgccccggggaatccctgtggatgtcccggattctattaggacagaaccagagacgcgggaccttagccccagctcaggcgccggtgccgagcggactt

SEQ ID NO: 185036 - DNA, 885 bp, Homo sapiens
  Payload ID: 16431
  Gene Symbol: SNX5
  Gene Name: sorting nexin 5
  ENST ID: ENST00000606602
  CDS Start-End: 361-528
gacgcgtcttgctgggagagtgtccgttgcttcccgtccgtgtcgcggccctgcggttggcggcctcctcgtggagcggagcaagggtaggccccacgtggcgtctttgcccggctccaagatggacggcagcggggactgggaggctgctctgggggagcacgtggcgccctgctcgcctgctcccggggcagctgggatggtggcggagtccggaggcctcctgccgccgtcgggcagggaggccggcggaggcggggccgtggccgcccccgagaggcgcccaggcggcggcggcggcggcccagcttcttctttcctcgcacagccaggcggcccctgctcgagtcccgcgtcgccatggccgcggttcccgagttgctgcagcagcaggaggaggaccgcagcaagaaccagagacgcgggaccttagccccagctcaggcgccggtgccgagcggacttggagagatgatctctggagaccccggaatgttctttttaaaactttcctcggcttcgtggtgaccagtaggtgaacgtgaaattgacttaacatgcgacagaccagtttggtttgttgcccccaaaataccctccttccccccaccttttactgagaagacttttttggggggggggcccaaacaacttgggaaattgcatcaagcgtccgaacatgctgcttacaactttagaaacgcaaaatgcgttgttgtgggagttgtgtaatttttagtaggtgctcaaatacttgctgaacttggtgtctatttttaagtcttgcccattgatgtaaactgtccctaggtcacgtgtatcttgaggtctaaaagattatttatgcaataaattgaaattcccatagccaattaaagattcaga

SEQ ID NO: 185037 - DNA, 845 bp, Homo sapiens
  Payload ID: 16431
  Gene Symbol: SNX5
  Gene Name: sorting nexin 5
  ENST ID: ENST00000463050
  CDS Start-End: 1-512
tgaaaagtgctgatgaagtcctttttactggagttaaggaggtagatgacttctttgagcaagagaagaacttccttattaactattacaataggatcaaagattcttgtgtgaaagctgacaaaatgaccagatctcataaaaatgttgccgatgactatatccacaccgcagcctgcttacatagcctggctttagaagagcccacagtcatcaaaaagtacctattgaaggttgctgagctatttgaaaaactaaggaaagtagagggtcgagtttcatcagatgaagatttgaagctaacagagctcctccgatactacatgctcaacattgaagctgctaaggatctcttatacagacgcaccaaagccctcattgactatgagaactcaaacaaagctctggataaggcccggttaaagagcaaagacgtcaagttggctgaggcacaccagcaggagtgctgccagaaatttgaacaactttccgaatctgcaaaagaaggttgagcaggacattcttctttctgtactgtaatttgaaaataatttcaaacttagaaaagttctacaaatagtgcaaaaaacacccatgtatccttcacccagtgtcagcacttcacccctctgccttatcacttgcacatgcacagtcatcctcatggctttgcgtgcttacaaacgttacacacctggtttttctgtaccattggagattaagttgcatatgtcatgcttcttttagccctaaaaacgttgtggtttatttcctaagactgaagacattctcttgtatggttacagtatggttgtttgctgtgataaacttaactttgggtctac

SEQ ID NO: 185038 - DNA, 2001 bp, Homo sapiens
  Payload ID: 16432
  Gene Symbol: SNX6
  Gene Name: sorting nexin 6
  ENST ID: ENST00000362031
  CDS Start-End: 32-1288
ctggccgccggctccctccggcagcagggagatgcgcgcctgcgccggccctcgcctcggagcagccatgatggaaggcctggacgacggcccggacttcctctcagaagaggaccgcggacttaaagcaataaatgtagatcttcaaagtgatgctgctctgcaggtggacatttctgatgctcttagtgagcgggataaagtaaaattcactgttcacacaaagagttcattgccaaattttaaacaaaacgagttttcagttgttcggcaacatgaggaatttatctggcttcatgattcctttgttgaaaatgaagactatgcaggttatatcattccaccagcaccaccaagacctgattttgatgcttcaagggaaaaactacagaagcttggtgaaggagaagggtcaatgacgaaggaagaattcacaaagatgaaacaggaactggaagctgaatatttggcaatattcaagaagacagttgcgatgcatgaagtgttcctgtgtcgtgtggcagcacatcctattttgagaagagatttaaatttccatgtcttcttggaatataatcaagatttgagtgtgcgaggaaaaaataaaaaagagaaacttgaagacttctttaaaaacatggttaaatcagcagatggagtaatcgtttcaggagtaaaggatgtagatgatttctttgagcacgaacgaacatttcttttggagtatcataaccgagttaaggatgcatctgctaaatctgatagaatgacaagatcccacaaaagtgctgcagatgattacaatagaattggttcttcattatatgctttaggaactcaggattctacagatatatgcaagttttttctcaaagtttcagaactgttcgataaaacaagaaaaatagaagcacgagtgtctgctgatgaagacctcaaactttctgatcttttaaaatattacttaagagaatctcaagctgctaaggatctcctgtatcgaaggtctaggtcactagtggattatgaaaatgctaataaagcactggataaagcaagagcaaaaaataaagatgttctacaggccgaaacttcccaacaattatgttgtcagaaatttgaaaaaatatctgagtctgcaaaacaagaacttatagattttaagacaagaagagttgctgcattcagaaaaaatttagtggaactggcagagttagaactgaagcatgcaaagggtaatctacagttgctgcagaactgcctggcagtgttaaatggagacacataagccacactccgccttcctgttaaaaagggctgccttccttcaaattttatttttgttttcttaatgatgttaagcatttatgctcactggaaacaaacaaaaagcagctgaaaaagtgcatcaactcctctttttctgagaaacatggagcagcgcacgcccaggcgatgccagtctgtgtgccgtgatgccgcactgtgttccccatgacagtggtccatcatcgtgcactcgtcatactcagaagtccaaagttcattcttctttaaagtagcctctataactctgtttattttataaatagtattccttatggctgccactcttatttacctttaaataatttctgaaatttaaccttttcagaatgcattgttgaaacaagataaagattgccttttttgaattttttaaattttgtttttaaaagcatataccaccttagttcattcatgtatcctggtaaagcatcttaatcagacttatttttaattactgaatatttcttagacgttttgggacagattttatgtaatctttataagtatgatttctgaagaaaagcaaatgcattagtatgtttgccttaaacttgtagactaaaccaagtattgtaaaataaacagcgataacagtgatagtttttaactctatggtcattgtatcactctggaaaatgtggagtagctgtaataaatctactcctgtattat

SEQ ID NO: 185039 - DNA, 3398 bp, Homo sapiens
  Payload ID: 16432
  Gene Symbol: SNX6
  Gene Name: sorting nexin 6
  Uniprot ID: Q9UNH7
  ENST ID: ENST00000396526
  CDS Start-End: 498-1370
tgggtgttctccgcggcgccgagtcccgggagcgcggtgggggcagcgggcgcggggcgggcgcggggaccgcgccagcctgtcactaatgtctccctttgtgtctcccccatctcatccttttccccggcgcgccgtgcccgccgaccccacaggaaggcctggacgacggcccggacttcctctcagaagaggaccgcggacttaaagcaataaatgtagatcttcaaagtgatgctgctctgcaggtggacatttctgatgctcttagtgagcgggataaagtaaaattcactgttcacacaaagagttcattgccaaattttaaacaaaacgagttttcagttgttcggcaacatgaggaatttatctggcttcatgattcctttgttgaaaatgaagactatgcaggttatatcattccaccagcaccaccaagacctgattttgatgcttcaagggaaaaactacagaagcttggtgaaggagaagggtcaatgacgaaggaagaattcacaaagatgaaacaggaactggaagctgaatatttggcaatattcaagaagacagttgcgatgcatgaagtgttcctgtgtcgtgtggcagcacatcctattttgagaagagatttaaatttccatgtcttcttggaatataatcaagatttgagtgtgcgaggaaaaaataaaaaagagaaacttgaagacttctttaaaaacatggttaaatcagcagatggagtaatcgtttcaggagtaaaggatgtagatgatttctttgagcacgaacgaacatttcttttggagtatcataaccgagttaaggatgcatctgctaaatctgatagaatgacaagatcccacaaaagtgctgcagatgattacaatagaattggttcttcattatatgctttaggaactcaggattctacagatatatgcaagttttttctcaaagtttcagaactgttcgataaaacaagaaaaatagaagcacgagtgtctgctgatgaagacctcaaactttctgatcttttaaaatattacttaagagaatctcaagctgctaaggatctcctgtatcgaaggtctaggtcactagtggattatgaaaatgctaataaagcactggataaagcaagagcaaaaaataaagatgttctacaggccgaaacttcccaacaattatgttgtcagaaatttgaaaaaatatctgagtctgcaaaacaagaacttatagattttaagacaagaagagttgctgcattcagaaaaaatttagtggaactggcagagttagaactgaagcatgcaaagggtaatctacagttgctgcagaactgcctggcagtgttaaatggagacacataagccacactccgccttcctgttaaaaagggctgccttccttcaaattttatttttgttttcttaatgatgttaagcatttatgctcactggaaacaaacaaaaagcagctgaaaaagtgcatcaactcctctttttctgagaaacatggagcagcgcacgcccaggcgatgccagtctgtgtgccgtgatgccgcactgtgttccccatgacagtggtccatcatcgtgcactcgtcatactcagaagtccaaagttcattcttctttaaagtagcctctataactctgtttattttataaatagtattccttatggctgccactcttatttacctttaaataatttctgaaatttaaccttttcagaatgcattgttgaaacaagataaagattgccttttttgaattttttaaattttgtttttaaaagcatataccaccttagttcattcatgtatcctggtaaagcatcttaatcagacttatttttaattactgaatatttcttagacgttttgggacagattttatgtaatctttataagtatgatttctgaagaaaagcaaatgcattagtatgtttgccttaaacttgtagactaaaccaagtattgtaaaataaacagcgataacagtgatagtttttaactctatggtcattgtatcactctggaaaatgtggagtagctgtaataaatctactcctgtattatgctttacagtgcaggtcttagtttttcttttttctcatttcttttgaaatggcatctcgaacaaagtccaccaatccctttacaaaagaatgaactgctcctctgtgtgtacttcatagaaggtggaatcggacagaggcaggttagtgacagttattcctgaaatacaggagcagagtacagtctgttgtggtttcccggattccgcgcctagctcagccaattaagcatgagacataggccattgagccacttagtagttatgcgagtggatagattggtatgtagagggaaagaggtctgctgtaaagaacaacacttgtttgtctgtggggaaagaaaagcagaatacttgagatgaaagttggcatacaaataggatactatcgccagtagttatattacaaacattatcggcctttctagtgtgaatgaacattagacacattattgtcattcctagtttaaagttaaggttgcgtggttggatttttccactatctttttctaatttttctaccatttggagaccgtaggcatttgggcctgtcaccccttggatgggttcctagtttgtttacattttcctgaaccctcctgagcgcccgttcttggtctaatccccagtcgtgatgattccacacttcctcagccgcatgttgtcttgcctcattcatgagctggtcagcgtttcgtctctttaactgacatgttccccagtgctgtttgaactgttgagtttccgttgctggctgagtgcgttttgtccttcacgtaaccttcgctggtaaaaataagcccatgtgatgtccaccagtggatgaatgctggaccgagagccctagcttctggatccaggtctaggcccttcatctgctgctctgtggcccagggcaggtttgcttgacctctgcctcagttctcgactctaaaggacatactgacctacctcacaggggtgttgtgaggattaataaatgttggtactctgctttggaaatgtgaaaatgctgtgtaaatgttaagaaatactaagtatagggccagaagctatacagtgtttcacttaaccgtttgccattctgtatttaccaaggtggtcttttctggggaaggaagtagagtggaaggtgcatcccttggcccctggtttacattattagggtgcttattgtaggaatgcactctaaaaagtgggcgtagaatgaaagcagccgtccagtggtcctcccttttctgtagtttcacttttcttgcttcaagttacagcagtcacctgaaatctgaaaatactaaatgaaaaactccagaaaca

SEQ ID NO: 185040 - DNA, 559 bp, Homo sapiens
  Payload ID: 16432
  Gene Symbol: SNX6
  Gene Name: sorting nexin 6
  ENST ID: ENST00000557341
  CDS Start-End: 2-400
gatgcgcgcctgcgccggccctcgcctcggagcagccatgatggaaggcctggacgacggcccggacttcctctcagaagaggaccgcggacttaaagcaataaatgtagatcttcaaagtgatgctgctctgcaggtggacatttctgatgctcttagtgagcgggataaagtaaaattcactgttcacacaaagattccaccagcaccaccaagacctgattttgatgcttcaagggaaaaactacagaagcttggtgaaggagaagggtcaatgacgaaggaagaattcacaaagatgaaacaggaactggaagcgggttggataacagagaaccttgggtttattctactgctacctccatcctctgcatccttcttttttgtcttcactgaatgactaccctcacagagatcaaacttctcccatcattggtcctgctggtttgctgtgaatatttggcaatattcaagaagacagttgcgatgcatgaagtgttcctgtgtcgtgtggcagcacatcctattttgagaagagatttaaatttccatgtcttct

SEQ ID NO: 185041 - DNA, 851 bp, Homo sapiens
  Payload ID: 16432
  Gene Symbol: SNX6
  Gene Name: sorting nexin 6
  ENST ID: ENST00000556712
  CDS Start-End: 1-452
ctcgcctcggagcagccatgatggaaggcctggacgacggcccggacttcctctcagaagaggaccgcggacttaaagcaataaatgtagatcttcaaagtgatgctgctctgcaggtggacatttctgatgctcttagtgagcgggataaagtaaaattcactgttcacacaaagagttcattgccaaattttaaacaaaacgagttttcagttgttcggcaacatgaggaatttatctggcttcatgattcctttgttgaaaatgaagactatgcaggttatatcattccaccagcaccaccaagacctgattttgatgcttcaagggaaaaactacagaagcttggtgaaggagaagggtcaatgacgaaggaagaattcacaaagatgaaacaggaactggaagcagatcaaacttctcccatcattggtcctgctggtttgctgtgaatatttggcaatattcaagaagacagttgcgatgcatgaagtgttcctgtgtcgtgtggcagcacatcctattttgagaagagatttaaatttccatgtcttcttggaatataatcaagatttgagtgtgcgaggaaaaaataaaaaagagaaacttgaagacttctttaaaaacatggttaaatcagcagatggagtaatcgtttcaggagtaaaggatgtagatgatttctttgagcacgaacgaacatttcttttggagtatcataaccgagttaaggatgcatctgctaaatctgatagaatgacaagatcccacaaaagtgctgcagatgattacaatagaattggttcttcattatatgctttaggaactcaggattctacagatatatgcaa

SEQ ID NO: 185042 - DNA, 1215 bp, Homo sapiens
  Payload ID: 16432
  Gene Symbol: SNX6
  Gene Name: sorting nexin 6
  ENST ID: ENST00000555416
  CDS Start-End: 3-512
agatgcgcgcctgcgccggccctcgcctcggagcagccatgatggaaggcctggacgacggcccggacttcctctcagaagaggaccgcggacttaaagcaataaatgtagatcttcaaagtgatgctgctctgcaggtggacatttctgatgctcttagtgagcgggataaagtaaaattcactgttcacacaaagagttcattgccaaattttaaacaaaacgagttttcagttgttcggcaacatgaggaatttatctggcttcatgattcctttgttgaaaatgaagactatgcaggttatatcattccaccagcaccaccaagacctgattttgatgcttcaagggaaaaactacagaagcttggtgaaggagaagggtcaatgacgaaggaagaattcacaaagatgaaacaggaactggaagcgggttggataacagagaaccttgggtttattctactgctacctccatcctctgcatccttcttttttgtcttcactgaatgactaccctcacagagatcaaacttctcccatcattggtcctgctggtttgctgtgaatatttggcaatattcaagaagacagttgcgatgcatgaagtgttcctgtgtcgtgtggcagcacatcctattttgagaagagatttaaatttccatgtcttcttggaatataatcaagatttgagtgtgcgaggaaaaaataaaaaagagaaacttgaagacttctttaaaaacatggttaaatcagcagatggagtaatcgtttcaggagtaaaggatgtagatgatttctttgagcacgaacgaacatttcttttggagtatcataaccgagttaaggatgcatctgctaaatctgatagaatgacaagatcccacaaaagtgctgcagatgattacaatagaattggttcttcattatatgctttaggaactcaggattctacagatatatgcaagttttttctcaaagtttcagaactgttcgataaaacaagaaaaatagaagcacgagtgtctgctgatgaagacctcaaactttctgatcttttaaaatattacttaagagaatctcaagctgctaaggatctcctgtatcgaaggtctaggtcactagtggattatgaaaatgctaataaagcactggataaagcaagagcaaaaaataaagatgttctacaggccgaaacttcccaacaattatgttg

SEQ ID NO: 185043 - DNA, 1855 bp, Homo sapiens
  Payload ID: 16432
  Gene Symbol: SNX6
  Gene Name: sorting nexin 6
  ENST ID: ENST00000556162
  CDS Start-End: 7-105
agggagatgcgcgcctgcgccggccctcgcctcggagcagccatgatggcctggacgacggcccggacttcctctcagaagaggaccgcggacttaaagcaataaatgtagatcttcaaagtgatgctgctctgcaggtggacatttctgatgctcttagtgagcgggataaagtaaaattcactgttcacacaaagagttcattgccaaattttaaacaaaacgagttttcagttgttcggcaacatgaggaatttatctggcttcatgattcctttgttgaaaatgaagactatgcaggttatatcattccaccagcaccaccaagacctgattttgatgcttcaagggaaaaactacagaagcttggtgaaggagaagggtcaatgacgaaggaagaattcacaaagatgaaacaggaactggaagcgggttggataacagagaaccttgggtttattctactgctacctccatcctctgcatccttcttttttgtcttcactgaatgactaccctcacagagatcaaacttctcccatcattggtcctgctggtttgctgtgaatatttggcaatattcaagaagacagttgcgatgcatgaagtgttcctgtgtcgtgtggcagcacatcctattttgagaagagatttaaatttccatgtcttcttggaatataatcaagatttgagtgtgcgaggaaaaaataaaaaagagaaacttgaagacttctttaaaaacatggttaaatcagcagatggagtaatcgtttcaggagtaaaggatgtagatgatttctttgagcacgaacgaacatttcttttggagtatcataaccgagttaaggatgcatctgctaaatctgatagaatgacaagatcccacaaaagtgctgcagatgattacaatagaattggttcttcattatatgctttaggaactcaggattctacagatatatgcaagttttttctcaaagtttcagaactgttcgataaaacaagaaaaatagaagcacgagtgtctgctgatgaagacctcaaactttctgatcttttaaaatattacttaagagaatctcaagctgctaaggatctcctgtatcgaaggtctaggtcactagtggattatgaaaatgctaataaagcactggataaagcaagagcaaaaaataaagatgttctacaggccgaaacttcccaacaattatgttgtcagaaatttgaaaaaatatctgagtctgcaaaacaagaacttatagattttaagacaagaagagttgctgcattcagaaaaaatttagtggaactggcagagttagaactgaagcatgcaaagggtaatctacagttgctgcagaactgcctggcagtgttaaatggagacacataagccacactccgccttcctgttaaaaagggctgccttccttcaaattttatttttgttttcttaatgatgttaagcatttatgctcactggaaacaaacaaaaagcagctgaaaaagtgcatcaactcctctttttctgagaaacatggagcagcgcacgcccaggcgatgccagtctgtgtgccgtgatgccgcactgtgttccccatgacagtggtccatcatcgtgcactcgtcatactcagaagtccaaagttcattcttctttaaagtagcctctataactctgtttattttataaatagtattccttatggctgccactcttatttacctttaaataatttctgaaatttaaccttttcagaatgcattgttgaaacaagataaagattgccttttttgaattttttaaattttgtttttaaaagcatataccaccttagttcattcatgtatcctg

SEQ ID NO: 185044 - DNA, 467 bp, Homo sapiens
  Payload ID: 16432
  Gene Symbol: SNX6
  Gene Name: sorting nexin 6
  ENST ID: ENST00000555648
  CDS Start-End: 72-467
gggccttctggtggacctccactcccacgcggggcggggtgcaggtggcgaagtggaaatggaggcgggagatggaacgcccccaccctccctcgacactttggggccatgaaaacccattctcggaccttcccagcggcaccctcaattttcacccggtgtggacatctcgaacttgctcccgcccacccttctgtctctctcaaatagtacagcttaaagcaataaatgtagatcttcaaagtgatgctgctctgcaggtggacatttctgatgctcttagtgagcgggataaagtaaaattcactgttcacacaaagagttcattgccaaattttaaacaaaacgagttttcagttgttcggcaacatgaggaatttatctggcttcatgattcctttgttgaaaatgaagactatgcaggttatatcattccaccagcaccaccaagacctgattttgatgct

SEQ ID NO: 185045 - DNA, 725 bp, Homo sapiens
  Payload ID: 16432
  Gene Symbol: SNX6
  Gene Name: sorting nexin 6
  ENST ID: ENST00000557265
  CDS Start-End: 7-725
agggagatgcgcgcctgcgccggccctcgcctcggagcagccatgatggaaggcctggacgacggcccggacttcctctcagaagaggaccgcggacttaaagcaataaatgtagatcttcaaagtgatgctgctctgcaggtggacatttctgatgctcttagtgagcgggataaagtaaaattcactgttcacacaaagattccaccagcaccaccaagacctgattttgatgcttcaagggaaaaactacagaagcttggtgaaggagaagggtcaatgacgaaggaagaattcacaaagatgaaacaggaactggaagctgaatatttggcaatattcaagaagacagttgcgatgcatgaagtgttcctgtgtcgtgtggcagcacatcctattttgagaagagatttaaatttccatgtcttcttggaatataatcaagatttgagtgtgcgaggaaaaaataaaaaagagaaacttgaagacttctttaaaaacatggttaaatcagcagatggagtaatcgtttcaggagtaaaggatgtagatgatttctttgagcacgaacgaacatttcttttggagtatcataaccgagttaaggatgcatctgctaaatctgatagaatgacaagatcccacaaaagtgctgcagatgattacaatagaattggttcttcattatatgctttaggaactcaggattctacagatatatgcaa

SEQ ID NO: 185046 - DNA, 1734 bp, Homo sapiens
  Payload ID: 16433
  Gene Symbol: SNX7
  Gene Name: sorting nexin 7
  Uniprot ID: Q9UNH6
  ENST ID: ENST00000306121
  CDS Start-End: 10-1365
actctcgggatggagggcgagcgccgggcatcgcaggcgccctcctcgggcctcccggccgggggcgccaacggggagagcccggggggcggcgccccctttccgggcagcagtggctcttccgccctgctgcaggcggaggtgctggatctggacgaggacgaggacgacctggaggtgttcagcaaggatgcctcattgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaagacatctcgtggggaatttgactccagtgaatttgaagttaggagacgatatcaagatttcctttggttgaagggaaaactggaagaagcacaccccactctgattattccaccattgccagaaaagtttatagtaaaaggaatggtggaacgctttaacgatgacttcattgagacacgcaggaaggctttacataaatttttgaaccgaattgctgatcatccaactttaacatttaatgaagacttcaaaatttttctcactgcacaagcttgggaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatgggtgttatgaaaagaagagaccaaatacaagcagaactggattccaaagttgaagttttgacctataaaaaggcagatactgatctgcttccagaggagattggaaaacttgaagataaagtggaatgtgctaataatgccctgaaagcagattgggagagatggaaacaaaatatgcaaaatgatatcaagttagcatttacagatatggctgaggagaatatccattattatgaacagtgccttgctacgtgggagtcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatgaa

SEQ ID NO: 185047 - DNA, 497 bp, Homo sapiens
  Payload ID: 16433
  Gene Symbol: SNX7
  Gene Name: sorting nexin 7
  ENST ID: ENST00000454199
  CDS Start-End: 173-497
atcttcctcgcggcagctcccgaacctgggaggctggtggctcaaaaccgctcccgccagctgcttttcgggcgaggccagccctgaactctgggagagcagccaagtttagagaaattattcttaatttagtgttgttgcttgtggatttgagacttgggatgcctcattgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaagacatctcgtggggaatttgactccagtgaatttgaagttaggagacgatatcaagatttcctttggttgaagggaaaactggaagaagcacaccccactctgattattccaccattgccagaaaagtttatagtaaaaggaatggtggaacgct

SEQ ID NO: 185048 - DNA, 1589 bp, Homo sapiens
  Payload ID: 16433
  Gene Symbol: SNX7
  Gene Name: sorting nexin 7
  ENST ID: ENST00000529992
  CDS Start-End: 32-1222
ggtggcggccggctgggcgcgcactctcgggatggagggcgagcgccgggcatcgcaggcgccctcctcgggcctcccggccgggggcgccaacggggagagcccggggggcggcgccccctttccgggcagcagtggctcttccgccctgctgcaggcggaggtgctggatctggacgaggacgaggacgacctggaggtgttcagcaaggatgcctcattgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaagacatctcgtggggaatttgactccagtgaatttgaagttaggagacgatatcaagatttcctttggttgaagggaaaactggaagaagcacaccccactctgattattccagaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatgggtgttatgaaaagaagagaccaaatacaagcagaactggattccaaagttgaagttttgacctataaaaaggcagatactgatctgcttccagaggagattggaaaacttgaagataaagtggaatgtgctaataatgccctgaaagcagattgggagagatggaaacaaaatatgcaaaatgatatcaagttagcatttacagatatggctgaggagaatatccattattatgaacagtgccttgctacgtgggagtcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatg

SEQ ID NO: 185049 - DNA, 1562 bp, Homo sapiens
  Payload ID: 16433
  Gene Symbol: SNX7
  Gene Name: sorting nexin 7
  ENST ID: ENST00000528824
  CDS Start-End: 60-170
aggtgctggatctggacgaggacgaggacgacctggaggtgttcagcaagggaggttgaatgtcactccagtttctcaagttgctgctgagagaagacctgagttcagatcacaacgctgtattcattactaagaagcctgttcattttaacgttacctggagatattaggatgcctcattgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaagacatctcgtggggaatttgactccagtgaatttgaagttaggagacgatatcaagatttcctttggttgaagggaaaactggaagaagcacaccccactctgattattccaccattgccagaaaagtttatagtaaaaggaatggtggaacgctttaacgatgacttcattgagacacgcaggaaggctttacataaatttttgaaccgaattgctgatcatccaactttaacatttaatgaagacttcaaaatttttctcactgcacaagcttgggaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatgggtgttatgaaaagaagagaccaaatacaagcagaactggattccaaagttgaagttttgacctataaaaaggcagatactgatctgtgccttgctacgtgggagtcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatgaa

SEQ ID NO: 185050 - DNA, 4727 bp, Homo sapiens
  Payload ID: 16434
  Gene Symbol: SNX8
  Gene Name: sorting nexin 8
  Uniprot ID: Q9Y5X2
  ENST ID: ENST00000222990
  CDS Start-End: 44-1441
gccgggtggcgcgggaggaagtcacgtgggagcgcgggctcacatgactggccgcgcgatggacccgctgcccgcggctgcagtcggggcggcagctgaggcggaggctgacgaggaggcggatcccccggcgtcagatctgccgacaccccaggccatcgagccccaggccatcgtgcagcaggtcccagcccccagtcgaatgcagatgccgcaggggaacccgctgctgctgtcccacaccctgcaggagctgctggccagggacaccgtgcaggtggagctcattccggagaagaagggcctcttcctgaagcatgtggagtatgaggtttccagccagcgcttcaagtcctcggtatacagacggtacaatgacttcgtggtcttccaggagatgctcctgcacaagttcccctaccgtatggtgcctgccctgccacccaagagaatgctgggagctgacagggagttcatcgaggccaggaggagagccctgaagcgcttcgtcaacctggtggcgcgacaccccctgttctccgaggatgtggtcctcaagctcttcctgtccttcagcggctcggatgtgcagaacaagttaaaggagtcagcacagtgcgtcggggacgaattcctgaactgtaagctggctaccagggccaaggacttcctcccagctgacatccaggctcagtttgccatcagccgggagctgatccggaacatctacaatagctttcacaagcttcgcgacagggccgagcggatcgcatcgcgggccatcgacaatgcggcagatcttctcatattcgggaaggagctaagtgcaatagggtctgacacgaccccgctgccctcctgggccgctctgaatagcagcacgtgggggtccctgaagcaggctctgaaaggcctgtctgtggaattcgcgctgctcgccgacaaggctgcacaacagggtaagcaggaagagaacgacgtggtggagaagctgaacctcttcttggatctgctgcagtcctataaggacctgtgcgagcggcatgagaagggcgtgttgcacaagcaccagcgggccctgcacaagtacagcctgatgaagaggcagatgatgagcgccaccgcgcagaaccgcgagccggagtccgtggagcagctggagtcccgcattgtggagcaggagaacgcgattcagacgatggagctgcggaactacttctccctgtactgcctgcaccaggagacgcagctcatccacgtctacctgcccctcacctcccacatcctccgcgccttcgtcaactctcagatccaagggcacaaggagatgagcaaggtgtggaacgacctgaggcccaagctcagctgcctctttgcgggaccacacagcaccctgaccccaccgtgctccccgccggaggacggcctgtgtcctcactagcgcctgaggctgaggtggtgctccctgcggccgcactaaaacctctttccaaacggtgtgtcccggtgtaattccctttggacggcagctcccctccccgccacgccccgtgctgcagctggagcagaggagctcacgcctgcgggtcgggaggcgcatccgtggaccatgggggcagctgggccacactgtccttcgccctgtggcctgctagcctggtcgagagaggtggtggggttctctggaatggtttcctcctgacacccagagctgtgcggggaggcagggatctctcatctcacagagattgtgcctgggggagcgtggaggcagggcctccaggtgctggaacagtcgggaggggcagcatcatggtgctcggtcagccgaggagagagggcagggctgccctgcagcccaggcatgggactgaccacggacagcgaggggacagccagtggtgctgaggctgggagggagggccattgggcgtggggcacgcacggtgaattttctagggaaattgctgcagtcaacacctggagccctggtctgggagtggcctgtggggtccagtggcctcatgccctgtgcccatatgatgaccccatgtgtgcctgtgtccacaccatgaccctgtgtgtgcccaggcctggaagacaaaggcgtgacggagagctggggctctgagagtgggcgctacagcagctgtgttctcgtcccctggactcccttgatttctggtggccagtgttggggtctgcaccgtgtggcactgaggctggatgggctggcagaggacaggtgggggcgtgggggggcgtgttccattccagctgaggctttagaggagggacagcccccttttaagtggatttccttctctgaggcacctagagccctcctcccagcctcccgtcacgcacttgccggcccagccacctgctcacagagggaaccagtggtctttcaggccccttccctgctctggatgaagaaggccattctcctgagctctgtggggctggactgtccgcctcaggcctgggtctgcttctgcccgaaccccttttgtggaaggtacatgggagcccagtggacccctgcacttctccggagcctgacgcccctccctggccggggaggggtgctggaagaggcccgccgggctccagggtttccgaggtccctccgctccgcagatgctcactggcctctggggcgttcactcctctcacggagggtgcttcccttccgcctgtacctacgggcagctcacggccgtgggatggagaggggactcctgtgtgtgccccgcaggcaggtgatccatcgtccactgcgagccggccagagggaacggccgtgccttctggccccgtgggctgtgctgactcggtggctgtggggctcgggcccagcctgccctgccctgtgggttctgctgctgccttcctgctgtgaggtgggctgcttccttctggccagatgagcagagggcagcgttccctttggagcccgatgggtgggctgtcccgtgagtccctagtccacccgagtcttgggctgcgctgccttctgacgcccctctgcagagacaggttctcagttgccatgaatggcaccatgacacccgagccatgaagcgtgaccccgtgtgggcagaaggctgcaaggcctctccgtccaccccgcaccttcctggggcctgtccagctgcaggaccatagaggctgtggggagtcgtggagggcatcaggtgctggggcctctgtgtctccagagtaggcaaggcacgcgctcctgacagcccccaaggattgagcaagacttcagaatgagcttttctgaaggagctttcctggcagggactccggggtcagtgagtgtatgagaggccacatacctggcggcatctccctgtgttggaaacttcaagagcagggtctcagggtcctcatgtccagaggctgaggatggaggtggaaggctggagggcaggggtgaggagggagcaggagggcaggagttgggggagcaggagggcaggggtcaggagaacaggagaacaggggtaagggagggcaggggtgagggggagcagaagagggatgagggggagcaggagggcaggcgttgggacaggagggcaggggtgagagagcaagggggcaggggtgagagagcaggagagcaggggtgaggagagcaggagagtaggggtgatggggaataggagggcaggggtgaggagggagcaggagaacgggtaagggagggcaggggtgagggggagcaggagggcaggggtgaggagagagcaagagggcaggggtgaggagagcaagagggcaggggtgggaaggcaggagggaggtgggggggcaggaaggcaggggtgggagggtcaggagggcagggtgaagggggggctggagggcagcggtgacgagggcagcctgtctcccacgtgtggtggctgcttcctgtgtgccctggggttggctctgtggaggggtgggcactggctttggaacacctccctccccttcctcctctgccacccagtgccttctaaagggcagcagaaagaggcctgctaggcaggggtggcggaggccaccttccttctcacaaatacttcttggccctggccctgtgctgcccgggcaggtccccaggctcaggggctgagaggctgcttactgctgcaggtggaggccccatgccggagggagagcggggttccccccatgcctctccagccctcctgctgcccacggcccaagcccaagcttgtgccggtcattacggccttgcctagctggcagggacagctgcgtgtgatgctggtggagatgccagatgccgcctgccctgtgaggacggctggcggggccgtgggaggggggttgtgggctggcggggctgtgggaagggggctgccgatcatggtgaaaggggacattttcattgggtcctcgtggtccgtgtcctgggtactcggggtcaccgtgcagacagctgccctttgtctgccggacacagtgcaggcaggggagacaggtttagggctctgacatggggcacagggactccgagccaagggatgtcagggcagctctgtgcatctgaggcctttgcccttgctttgcgggtcagttcatgtccaaagcactttaggaggctgcagggatcaatacccaatatacccaacaactggaattgtttacacatgacctacattttggacggtttatcaataaacatgtgtgaacaactgtta

SEQ ID NO: 185051 - DNA, 762 bp, Homo sapiens
  Payload ID: 16434
  Gene Symbol: SNX8
  Gene Name: sorting nexin 8
  ENST ID: ENST00000435060
  CDS Start-End: 91-762
gtgtcattgaggcaggtccagggcctttgctgaccctcggggctccttcacccctgccccgagccttcccctcttgcctgggcgacttccatgcaccctgggctcccatcaacccttacctgcagctgctcgctcatgtcagatctgccgacaccccaggccatcgagccccaggccatcgtgcagcaggtcccagcccccagtcgaatgcagatgccgcaggggaacccgctgctgctgtcccacaccctgcaggagctgctggccagggacaccgtgcaggtggagctcattccggagaagaagggcctcttcctgaagcatgtggagtatgaggtttccagccagcgcttcaagtcctcggtatacagacggtacaatgacttcgtggtcttccaggagatgctcctgcacaagttcccctaccgtatggtgcctgccctgccacccaagagaatgctgggagctgacagggagttcatcgaggccaggaggagagccctgaagcgcttcgtcaacctggtggcgcgacaccccctgttctccgaggatgtggtcctcaagctcttcctgtccttcagcggctcggatgtgcagaacaagttaaaggagtcagcacagtgcgtcggggacgaattcctgaactgtaagctggctaccagggccaaggacttcctcccagctgacatccaggctcagtttgccatcagccgggagctgatccggaacatctacaatagctttcacaagcttcgcgacagg

SEQ ID NO: 185052 - DNA, 415 bp, Homo sapiens
  Payload ID: 16434
  Gene Symbol: SNX8
  Gene Name: sorting nexin 8
  ENST ID: ENST00000419693
  CDS Start-End: 289-415
gttagcaagaaagtgatgtgttccgggtaggggaattctgttttggtattattttgtctttcctgagaaaagcatcacaaaaagagatgtttgcccatcctgtttgctggggtagtgggaagagaccgggggtgatggtggtgctggctggacgtgggtggtttcacaggacctgctgtgtctgagaggagccatgcggtgattagaagcttggaggctgcagatctgccgacaccccaggccatcgagccccaggccatcgtgcagcaggtcccagcccccagtcgaatgcagatgccgcaggggaacccgctgctgctgtcccacaccctgcaggagctgctggccagggacaccgtgcaggtggagctcattccggagaagaagggcctcttcctgaagcatgtggagtatg

SEQ ID NO: 185053 - DNA, 583 bp, Homo sapiens
  Payload ID: 16434
  Gene Symbol: SNX8
  Gene Name: sorting nexin 8
  ENST ID: ENST00000447136
  CDS Start-End: 329-583
aaaaggacagactacttcaaaatagaaaaggaattcggggcgagccagagagggcccacacgactagaaggacgactgcctggcgcgatacaaaaatggtctccttgtgttgcccgggctggtctcgaactcctgacctcaagtgatctgcctgcctcggcctctgaaagtgtggggattacaggcatgacccgtcacaccgggctggaatgcacggatcttatatgctacaaattaaagaatcttcacagctacgcacagtgatctgccgacaccccaggccatcgagccccaggccatcgtgcagcaggtcccagcccccagtcgaatgcagatgccgcaggggaacccgctgctgctgtcccacaccctgcaggagctgctggccagggacaccgtgcaggtggagctcattccggagaagaagggcctcttcctgaagcatgtggagtatgaggtttccagccagcgcttcaagtcctcggtatacagacggtacaatgacttcgtggtcttccaggagatgctcctgcacaagttcccctaccgtatggtgcctgccctgccacccaagagaatgctg

SEQ ID NO: 185054 - DNA, 634 bp, Homo sapiens
  Payload ID: 16434
  Gene Symbol: SNX8
  Gene Name: sorting nexin 8
  ENST ID: ENST00000435336
  CDS Start-End: 154-634
gactacttcaaaatagaaaaggaattcggggcgagccagagagggcccacacgactagaaggacgactgcctggcgcgatacaaaaatatctgccgacaccccaggccatcgagccccaggccatcgtgcagcaggtcccagcccccagtcgaatgcagatgccgcaggggaacccgctgctgctgtcccacaccctgcaggagctgctggccagggacaccgtgcaggtggagctcattccggagaagaagggcctcttcctgaagcatgtggagtatgaggtttccagccagcgcttcaagtcctcggtatacagacggtacaatgacttcgtggtcttccaggagatgctcctgcacaagttcccctaccgtatggtgcctgccctgccacccaagagaatgctgggagctgacagggagttcatcgaggccaggaggagagccctgaagcgcttcgtcaacctggtggcgcgacaccccctgttctccgaggatgtggtcctcaagctcttcctgtccttcagcggctcggatgtgcagaacaagttaaaggagtcagcacagtgcgtcggggacgaattcctgaactgtaagctggctaccagggccaaggacttcctcccagctgaca

SEQ ID NO: 185055 - DNA, 686 bp, Homo sapiens
  Payload ID: 16434
  Gene Symbol: SNX8
  Gene Name: sorting nexin 8
  ENST ID: ENST00000457286
  CDS Start-End: 159-686
ccgggggattggtgggacggatggctctgatgtccttggctggctccgcttgtcccttgactctgatttgagtcagaggaaatcatctgagcgatctgccgacaccccaggccatcgagccccaggccatcgtgcagcaggtcccagcccccagtcgaatgcagatgccgcaggggaacccgctgctgctgtcccacaccctgcaggagctgctggccagggacaccgtgcaggtggagctcattccggagaagaagggcctcttcctgaagcatgtggagtatgaggtttccagccagcgcttcaagtcctcggtatacagacggtacaatgacttcgtggtcttccaggagatgctcctgcacaagttcccctaccgtatggtgcctgccctgccacccaagagaatgctgggagctgacagggagttcatcgaggccaggaggagagccctgaagcgcttcgtcaacctggtggcgcgacaccccctgttctccgaggatgtggtcctcaagctcttcctgtccttcagcggctcggatgtgcagaacaagttaaaggagtcagcacagtgcgtcggggacgaattcctgaactgtaagctggctaccagggccaaggacttcctcccagctgacatccaggctcagtttgccatcagccgggagctgatccggaacatctac

SEQ ID NO: 185056 - DNA, 4198 bp, Homo sapiens
  Payload ID: 16435
  Gene Symbol: SNX9
  Gene Name: sorting nexin 9
  Uniprot ID: Q9Y5X1
  ENST ID: ENST00000392185
  CDS Start-End: 172-1959
agcggctgggcctgagcgtcgagactcggggccgaggcggaggagcggccgccgcgccggggcccagccggagccgccgccctcgcccttgcctttgcctgcgcggctcagaatcaccatccgcggcgcgggagacgagccggccgtcccgggccgggggacccgcccgccatggccaccaaggctcgggttatgtatgattttgctgctgaacctggaaataatgaactgacggttaatgaaggagaaatcatcacaatcacaaatccggatgtaggtggaggatggctggaaggaagaaacatcaaaggagaacgagggctggttcccacagactacgttgaaattttacccagtgatggaaaagatcaattttcttgtggaaattcagtggctgaccaagccttccttgattctctctcagccagcacagctcaggccagttcgtcggctgccagcaacaatcaccaggttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaaatttcctggatttgcgaaacctggcacggaacagtatttgttggccaaacaactagcaaaacccaaagagaaaattcccatcattgttggagattatggcccaatgtgggtttatcctacctctacttttgactgtgtggtagcagatcccaggaaaggctccaaaatgtatggtctaaagagctacatcgaatatcagctaacacctactaacactaatcgatctgtaaaccacaggtataagcactttgactggttatatgagcgtctcctggttaagtttgggtcagccattccaatcccttctcttccagacaaacaagtcacaggccgctttgaagaggaatttatcaaaatgcgcatggagagacttcaggcctggatgaccaggatgtgtcgccatccagtaatctcagaaagtgaagttttccagcagttcctaaatttccgagatgagaaggaatggaaaactggaaagaggaaggccgagagagatgagctggcgggagtcatgatattttccaccatggaaccagaggcacctgacttggacttagtagaaatagagcagaagtgcgaggctgtggggaagttcaccaaggccatggatgacggcgtgaaggagctgctgacggtggggcaggagcactggaagcgctgcacgggcccattacccaaggaatatcagaagataggaaaggccttgcagagtttggccacagtgttcagttccagtggctatcaaggtgaaacagatctcaatgatgcaataacagaagcaggaaagacttatgaagaaattgccagtctcgtggcagaacagccaaagaaagatctccatttcctgatggaatgtaatcacgagtataaaggttttcttggctgcttccctgacatcattggcactcacaagggagcaatagaaaaagtgaaagaaagtgacaaactagttgcaacaagtaaaatcaccctacaagacaaacagaacatggtgaagagagtcagcatcatgtcttacgcgttgcaagctgagatgaatcactttcacagtaaccggatctatgattacaacagtgtcatccgcctgtacctggagcagcaagtgcaattttacgaaacgattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtatatttttataactcctttcagtcctctggggctcctgtcattgagggaagtcgttacgcctttcactgccacagttacagctcaagtgcttacacttcaagagggaggacgctgggggcccctggggctgctagtgccatcgtggtgtgtggcaggtgggccatcccatgtccctccagggggaccccacagcctggcagatgagcagatacccctggccacccatgtcctcagcgacatttctgatgtgctgctcttatgtgaggaccagtgctttctctctttgcacttccttcctaatcttggttaaggcatgttttatgccatgaagaatacattagaagaattgagggactttgtagagaattttgtggctttggtccaacgggtgagtggctgtgcggaggcctgtgttcgggagggcctgggagaaggagggcacccagcaccccggcgtctctggccctttcttattctttggctcctcatccaccgtgatgagaagcgctgctgtggccacggcacactgcttggcttgggtggcgggttcatggccagttggtgtcatcagcaaagagaaaaagcacaggttagctccccattagatggaaaagtgtagggactgagaagggctgcagcctcagcagtgtacagagtccccggcgctctgaggttggagagaaagaacagaccagcgcccttcccgactacatccgaaacttcacacagggtgtttctgagcaccagcacttccagcgcttcacttaacggcataaagcaaaacaggaccttggcacaccgtcagctcgaactcaacactggcagccaccgtctcacccctgcggaggagcgctcccgtctcccacaggtgccttaccgcgttccctcccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgtacagtaaattctcaaagcactttttcaaaacactttttggactttgtgtgtgatttttgttgttgttgttaagtactttttattccagctgctgaaaatggtccaggtaatgaattcttccccaaatcctatttcttctgacatgaattcatcatttcagttccgtaggtcagtgttgcggtccgggaagcgtatcataaccacctgggagttgccaagaagcagacagtctcccagtgtctgactctcggatatttggatttgactggtgtgaggcaaagtgaaaaagggatgggggaaatggagatggcacgggctcctcagagcgtggtagccgactgtgaggaaaagcagagggaatgtgaaagaaaataagagaatccacgggatttgatgcctggaagattctccttcaagtggcaacatggcatatatatccttctccggggagtcacatgcaccatttggttcttagatacgttgatgttttgatttttaatgatttgtatcaacctgtaggtaccacagaagagctgtagtcatacaatcacataacttttacaaatatagtgg

SEQ ID NO: 185057 - DNA, 553 bp, Homo sapiens
  Payload ID: 16435
  Gene Symbol: SNX9
  Gene Name: sorting nexin 9
  ENST ID: ENST00000614800
  CDS Start-End: 364-553
aaaggatcccaggctctccccagtcagaagcttaactgaagccagagctgggtggaccctcgcccaccaggaatagcggctataatgacaagggtcattgtgtgttttgctgcttaatgaagcagagacattcctcaggcattttgtcctggacacagaccatgttccgtgctccccaccttgcactgaggtgcgtggaagttggcctacagcaacgagagacagagccctgaaagcttctcagacttcagtcctgcccttccacaagctctgcggaggcccagtcctgcttctactggacacttctcaggcactgacaagaaaagtctccattgctcgggggagaaacaaagggctcgggttatgtatgattttgctgctgaacctggaaataatgaactgacggttaatgaaggagaaatcatcacaatcacaaatccggatgtaggtggaggatggctggaaggaagaaacatcaaaggagaacgagggctggttcccacagactacgttgaaattttacccagtgatggaaaagatcaattttcttgtg

SEQ ID NO: 185058 - DNA, 4024 bp, Homo sapiens
  Payload ID: 16435
  Gene Symbol: SNX9
  Gene Name: sorting nexin 9
  ENST ID: ENST00000611124
  CDS Start-End: 1-1785
tcaaccaaagctcgggttatgtatgattttgctgctgaacctggaaataatgaactgacggttaatgaaggagaaatcatcacaatcacaaatccggatgtaggtggaggatggctggaaggaagaaacatcaaaggagaacgagggctggttcccacagactacgttgaaattttacccagtgatggaaaagatcaattttcttgtggaaattcagtggctgaccaagccttccttgattctctctcagccagcacagctcaggccagttcgtcggctgccagcaacaatcaccaggttggcagtggcaatgacccctggtcagcctggagtgcctccaaatctgggaactgggaaagctcagaaggctggggggcccagccagagggggctggagcccaaagaaacacaaacactcccaacaactgggacactgccttcggccacccccaggcctaccaaggaccagcaactggtgatgatgatgactgggatgaagactgggatgggcccaaatcctcttcctactttaaggattcagagtcagctgatgcaggcggcgctcagcgaggaaacagtcgtgctagttcctcatccatgaaaattccccttaacaaatttcctggatttgcgaaacctggcacggaacagtatttgttggccaaacaactagcaaaacccaaagagaaaattcccatcattgttggagattatggcccaatgtgggtttatcctacctctacttttgactgtgtggtagcagatcccaggaaaggctccaaaatgtatggtctaaagagctacatcgaatatcagctaacacctactaacactaatcgatctgtaaaccacaggtataagcactttgactggttatatgagcgtctcctggttaagtttgggtcagccattccaatcccttctcttccagacaaacaagtcacaggccgctttgaagaggaatttatcaaaatgcgcatggagagacttcaggcctggatgaccaggatgtgtcgccatccagtaatctcagaaagtgaagttttccagcagttcctaaatttccgagatgagaaggaatggaaaactggaaagaggaaggccgagagagatgagctggcgggagtcatgatattttccaccatggaaccagaggcacctgacttggacttagtagaaatagagcagaagtgcgaggctgtggggaagttcaccaaggccatggatgacggcgtgaaggagctgctgacggtggggcaggagcactggaagcgctgcacgggcccattacccaaggaatatcagaagataggaaaggccttgcagagtttggccacagtgttcagttccagtggctatcaaggtgaaacagatctcaatgatgcaataacagaagcaggaaagacttatgaagaaattgccagtctcgtggcagaacagccaaagaaagatctccatttcctgatggaatgtaatcacgagtataaaggttttcttggctgcttccctgacatcattggcactcacaagggagcaatagaaaaagtgaaagaaagtgacaaactagttgcaacaagtaaaatcaccctacaagacaaacagaacatggtgaagagagtcagcatcatgtcttacgcgttgcaagctgagatgaatcactttcacagtaaccggatctatgattacaacagtgtcatccgcctgtacctggagcagcaagtgcaattttacgaaacgattgcagaaaagctgaggcaggccctcagccgctttccagtgatgtaggacagaacgggccttgaagagaatgccgcgtgctttctcctgacttggggcaatgcaattcaaaactttttttcccctattattcagaaaaaaaaggaaacaaaaccaaaaagaaagagttgcaaaaaactgcatttattttattagccaccctaaatgcgtcagttatttagggatggtcttttgttcatttccgcatccattatttaaaccagtggaaattgtctctatttttggaaagtacttaaaagttaccagaattttcaatggaaaatgaggggtttctccccactgatattttacatagagtcataatttatatgtcttataaattataagtcttatataatttataagtctcccacaatcttccagttcttacccagtgtcagataattaattactaattactttcttaaaaacatgaactatgccagaataaaaaatatctatgtttgtatatttttataactcctttcagtcctctggggctcctgtcattgagggaagtcgttacgcctttcactgccacagttacagctcaagtgcttacacttcaagagggaggacgctgggggcccctggggctgctagtgccatcgtggtgtgtggcaggtgggccatcccatgtccctccagggggaccccacagcctggcagatgagcagatacccctggccacccatgtcctcagcgacatttctgatgtgctgctcttatgtgaggaccagtgctttctctctttgcacttccttcctaatcttggttaaggcatgttttatgccatgaagaatacattagaagaattgagggactttgtagagaattttgtggctttggtccaacgggtgagtggctgtgcggaggcctgtgttcgggagggcctgggagaaggagggcacccagcaccccggcgtctctggccctttcttattctttggctcctcatccaccgtgatgagaagcgctgctgtggccacggcacactgcttggcttgggtggcgggttcatggccagttggtgtcatcagcaaagagaaaaagcacaggttagctccccattagatggaaaagtgtagggactgagaagggctgcagcctcagcagtgtacagagtccccggcgctctgaggttggagagaaagaacagaccagcgcccttcccgactacatccgaaacttcacacagggtgtttctgagcaccagcacttccagcgcttcacttaacggcataaagcaaaacaggaccttggcacaccgtcagctcgaactcaacactggcagccaccgtctcacccctgcggaggagcgctcccgtctcccacaggtgccttaccgcgttccctcccgctgctttcatttttctgacctaataattacgggaaatggaaagtctgggccagcatcaataaaatgacaccaaaaataagtagatgaaatcaaatgaatatgagaacatcttgttcttcaatatcacgggtttttgttaatgtttcataagtaattctccccacttgatttttcttctataaaatcccatagaacaatgtttatgctatagccatttaatatatgtacaaattgtaaagaatatgtataaatgttttacacgaatgtaagagcatgtagaagccaacatataaataaattgtttaaaaaaactgtacagtaaattctcaaagcactttttcaaaacactttttggactttgtgtgtgatttttgttgttgttgttaagtactttttattccagctgctgaaaatggtccaggtaatgaattcttccccaaatcctatttcttctgacatgaattcatcatttcagttccgtaggtcagtgttgcggtccgggaagcgtatcataaccacctgggagttgccaagaagcagacagtctcccagtgtctgactctcggatatttggatttgactggtgtgaggcaaagtgaaaaagggatgggggaaatggagatggcacgggctcctcagagcgtggtagccgactgtgaggaaaagcagagggaatgtgaaagaaaataagagaatccacgggatttgatgcctggaagattctccttcaagtggcaacatggcatatatatccttctccggggagtcacatgcaccatttggttcttagatacgttgatgttttgatttttaatgatttgtatcaacctgtaggtaccacagaagagctgtagtcatacaatcacataacttttacaaatatagtgg

SEQ ID NO: 185059 - DNA, 542 bp, Homo sapiens
  Payload ID: 16435
  Gene Symbol: SNX9
  Gene Name: sorting nexin 9
  ENST ID: ENST00000614703
  CDS Start-End: 291-542
acctctgactctgcgctgccacccggcagtgcgaggaccacatactgaccaggtgtggagccgatgcccagacccgtgatggcagaccatgttccgtgctccccaccttgcactgaggtgcgtggaagttggcctacagcaacgagagacagagccctgaaagcttctcagacttcagtcctgcccttccacaagctctgcggaggcccagtcctgcttctactggacacttctcaggcactgacaagaaaagtctccattgctcgggggagaaacaaagggctcgggttatgtatgattttgctgctgaacctggaaataatgaactgacggttaatgaaggagaaatcatcacaatcacaaatccggatgtaggtggaggatggctggaaggaagaaacatcaaaggagaacgagggctggttcccacagactacgttgaaattttacccagtgatggaaaagatcaattttcttgtggaaattcagtggctgaccaagccttccttgattctctctcagccagcacagctcaggccagt

SEQ ID NO: 185060 - DNA, 1506 bp, Homo sapiens
  Payload ID: 16436
  Gene Symbol: SNX21
  Gene Name: sorting nexin family member 21
  Uniprot ID: Q969T3
  ENST ID: ENST00000342644
  CDS Start-End: 69-668
gaacccggccgacctccatgggctgcggggggctgcacccggacccctggggcgcggcgcgcccctgaatgcaccgtgggacgcaggagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgctctacaccctcgccgtgatcggcccaggaccgccagattgccagccagcccagatctctcgccgttactcggactttgagcggctgcaccgaaacctgcagcggcaattccggggcccaatggctgccatctccttcccccagtctcactaagttgccaggctggtctcaagcgcctgggttcaagggatcctcccgcctcagcctcctgagcagctgggattacaggcgcacatcaccatgcccaacctccaagtggacttcttgcaaagggtctggcccagggcagggctgccccacacaagggtgcactgagtgtcgtggctgctccaaatgccccttcatgagcttattatggaccgtcattgaggggtaactcctcccacaggaaccccagttgacagtttaaaagcactttcacacctctcctcgcttcctcaaaaagatcacagagggaggagctctgagaacagtctccttcaacagctcggccaagcagaactgctgtacctctgaccacttgtgttaggaaaactatcggctccctgtataataaatcaagccaggtcctccaagtggtaattcatgaaaaatatccccactaccaccaccaaggggaagaaaggactcagaagagaggacttgaggccatgaggtctggcctcttccctccccatctggagactctttctcccttgctggctttgggcccaagtttgatgtttatgaggatgattgctggtttcccttacacatagcagagctcactcagttctcacagtagccaaatgaagcagttatgtgttgtccagttttccagaccaggactgaaatccagagagggtcaggaatttggccccatgatgaagccaaatctgaacccatgtcctcacttcaaggttatcaatcttggattgtgatgctattggtacttgagaataccccttatctgagtataaagaatccttgagttttgtccttggtttatcaa

SEQ ID NO: 185061 - DNA, 771 bp, Homo sapiens
  Payload ID: 16436
  Gene Symbol: SNX21
  Gene Name: sorting nexin family member 21
  ENST ID: ENST00000372541
  CDS Start-End: 72-521
tcctgcgccgggctggggtacccctcctccgggatccggtacacagcgtcgcgcgctccccccagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgacaaacctcagctctacaccctcgccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttctt

SEQ ID NO: 185062 - DNA, 1824 bp, Homo sapiens
  Payload ID: 16436
  Gene Symbol: SNX21
  Gene Name: sorting nexin family member 21
  ENST ID: ENST00000372542
  CDS Start-End: 313-1407
cccctggggcgcggcgcgcccctgaatgcaccgtgggacgcaggaggtagaggcgcacgaggcggcgcaagagacatcgggagggtcctgagcccctccggggaggaacgcggtcctaggctgagtgggttggggggaaagcgatgctggctgggtcccctggttcgcaagacctcggactgccagggggtggggcctcaccgcgcccctccctctccggttcgggccccgcccctcctcctcctgcgccgggctggggtacccctcctccgggatccggtacacagcgtcgcgcgctccccccagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgctctacaccctcgccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttcttcgtgctgccggagctgcggcgggcacagagcctcacctgtactggcctctatcgtgaggctctggcactctgggccaatgcctggcagctgcaagcccagctgggcaccccctctggcccagaccgccccctgctgaccctggctgggctggccgtgtgccaccaggagctggaagaccctggagaggcccgggcatgctgtgagaaggccctgcagctgcttggggacaagagcctccaccctttgctggcaccctttctggaggcccatgtccggctctcctggcgcctgggcctggacaaacgtcaatcagaggctcggctccaagccctgcaggaggcaggccttacccccacaccaccccccagtctcaaagaattgctcatcaaggaggtgctggactaacccttgcctagatttaaggccactgtgaggagaggggttgccccagaaggcaggggaaggacctgatgagaacagaatagctgggaggctgcagagggtgctgggagcccctagaagttccaaaagagaatgtgaagcagatcaaggaaacttctgttgagctaggctcagggtgagctttggctggggttgcccttgtgtagtacagggaagtctgacacagcctctccagcctataaacagccggggggctgtggcacaggttggggcaatgttcccttgttggtgggcccccaagctggcaaggcctcttggctgaaggccagggactctgcccctggagtcctggagttaagggatgaaggcaaggctgcaggtctggcccaggggaattaaaagccagccactccagtggta

SEQ ID NO: 185063 - DNA, 1607 bp, Homo sapiens
  Payload ID: 16436
  Gene Symbol: SNX21
  Gene Name: sorting nexin family member 21
  Uniprot ID: Q969T3
  ENST ID: ENST00000491381
  CDS Start-End: 69-1190
gaacccggccgacctccatgggctgcggggggctgcacccggacccctggggcgcggcgcgcccctgaatgcaccgtgggacgcaggagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgctctacaccctcgccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttcttcgtgctgccggagctgcggcgggcacagagcctcacctgtactggcctctatcgtgaggctctggcactctgggccaatgcctggcagctgcaagcccagctgggcaccccctctggcccagaccgccccctgctgaccctggctgggctggccgtgtgccaccaggagctggaagaccctggagaggcccgggcatgctgtgagaaggccctgcagctgcttggggacaagagcctccaccctttgctggcaccctttctggaggcccatgtccggctctcctggcgcctgggcctggacaaacgtcaatcagaggctcggctccaagccctgcaggaggcaggccttacccccacaccaccccccagtctcaaagaattgctcatcaaggaggtgctggactaacccttgcctagatttaaggccactgtgaggagaggggttgccccagaaggcaggggaaggacctgatgagaacagaatagctgggaggctgcagagggtgctgggagcccctagaagttccaaaagagaatgtgaagcagatcaaggaaacttctgttgagctaggctcagggtgagctttggctggggttgcccttgtgtagtacagggaagtctgacacagcctctccagcctataaacagccggggggctgtggcacaggttggggcaatgttcccttgttggtgggcccccaagctggcaaggcctcttggctgaaggccagggactctgcccctggagtcctggagttaagggatgaaggcaaggctgcaggtctggcccaggggaattaaaagccagccactccagtggta

SEQ ID NO: 185064 - DNA, 1043 bp, Homo sapiens
  Payload ID: 16436
  Gene Symbol: SNX21
  Gene Name: sorting nexin family member 21
  Uniprot ID: Q969T3
  ENST ID: ENST00000462307
  CDS Start-End: 90-566
tgagcccggcggagccctgcagaacccggccgacctccatgggctgcggggggctgcacccggacccctggggcgcggcgcgcccctgaatgcaccgtgggacgcaggagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgacaaacctcagctctacaccctcgccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttcttcgtgctgccggagctgcggcgggcacagagcctcacctgtactggcctctatcgtgaggctctggcactctgggccaatgcctggcagctgcaagcccagctgggcaccccctctggcccagaccgccccctgctgaccctggctgggctggccgtgtgccaccaggagctggaagaccctggagaggcccgggcatgctgtgagaaggccctgcagctgcttgggg

SEQ ID NO: 185065 - DNA, 587 bp, Homo sapiens
  Payload ID: 16436
  Gene Symbol: SNX21
  Gene Name: sorting nexin family member 21
  ENST ID: ENST00000614929
  CDS Start-End: 90-587
tgagcccggcggagccctgcagaacccggccgacctccatgggctgcggggggctgcacccggacccctggggcgcggcgcgcccctgaatgcaccgtgggacgcaggagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgagacagggtcttgccatgttgcccaggctggtctcgaactcctggccttaa

SEQ ID NO: 185066 - DNA, 1308 bp, Homo sapiens
  Payload ID: 16437
  Gene Symbol: SNX27
  Gene Name: sorting nexin family member 27
  ENST ID: ENST00000368838
  CDS Start-End: 1-1308
atgggattgtctttttccctttttccccttaggaaccacgtgaatgttgagggggcgacacacaagcaggtggtggacctgattcgagcaggcgagaaggaattgatcttgacagtgttatctgtacctcctcatgaggcagataacctagatcccagtgacgactcgttgggacaatcattttatgattacacagaaaagcaagcagtgcccatatcggtccccagatacaaacatgtggagcagaatggtgagaagtttgtggtatataatgtttacatggcagggaggcagctgtgttctaagcggtaccgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagaggaatattag

SEQ ID NO: 185067 - DNA, 7070 bp, Homo sapiens
  Payload ID: 16437
  Gene Symbol: SNX27
  Gene Name: sorting nexin family member 27
  ENST ID: ENST00000368841
  CDS Start-End: 138-335
ctcggtggccgagtcggtcccgcggccggcggatcgggcgcgcgcgtcgggggtcgtccggctgccaggcagggcgagcacgcgccgggaggccttggaggcgtagggggcgggggtacggctcgcctgctcgcaagatggcggacgaggacggggaagggattcatccctcagcccctcacaggaacggaggtggcggcggcggcggggggtctgggctccactgcgccgggaacggcggcgggggaggcggcggcccgcgggtcgtgcgcatcgtcaagtccgagtccggctacggcttcaacgtgcggggccaagaaccacgtgaatgttgagggggcgacacacaagcaggtggtggacctgattcgagcaggcgagaaggaattgatcttgacagtgttatctgtacctcctcatgaggcagataacctagatcccagtgacgactcgttgggacaatcattttatgattacacagaaaagcaagcagtgcccatatcggtccccagatacaaacatgtggagcagaatggtgagaagtttgtggtatataatgtttacatggcagggaggcagctgtgttctaagcggtaccgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagaggaatattagttagagactgattatctcatgtgagccaggacattcttccagcaaggttggcctctggatggtgaacgggctgtgcaaaaaagccctgcttcttcccttgtctagagggtggacattggctacaggctcttccatctctcatgacttcatggaccctcctctgccagttttttaaatcagatcaccctccatgttgttcctgacccacaggggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacagaatttggaagattctgaataattagttacttattctcaaagaaaatctttgaaagaatcaggaggtcaagtcaagaacatgaaaatttatattttagtacagtagaaagaacattgggctctgggaattttatctgggttttctcctggcttttttttccctctgtgtaattttgggtaaatcagcctccctagctttcagttttctcttctgtgaaacaggaagactgaaccacgtaattaatatccaaggtcccttccggctctaaaaggctatgattctagatgagaagttatatcaagaaagatgtggccaatcagattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgccttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaacgcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaa

SEQ ID NO: 185068 - DNA, 7197 bp, Homo sapiens
  Payload ID: 16437
  Gene Symbol: SNX27
  Gene Name: sorting nexin family member 27
  Uniprot ID: Q96L92
  ENST ID: ENST00000368843
  CDS Start-End: 121-1707
tcccgcggccggcggatcgggcgcgcgcgtcgggggtcgtccggctgccaggcagggcgagcacgcgccgggaggccttggaggcgtagggggcgggggtacggctcgcctgctcgcaagatggcggacgaggacggggaagggattcatccctcagcccctcacaggaacggaggtggcggcggcggcggggggtctgggctccactgcgccgggaacggcggcgggggaggcggcggcccgcgggtcgtgcgcatcgtcaagtccgagtccggctacggcttcaacgtgcggggccaagtgagcgagggcgggcaactgcggagcatcaacggggagctgtacgcgccgctgcagcatgtgagcgccgtgctgcccgggggggcggccgatcgggccggggtgcgcaagggggaccgcatcctggaggtgaaccacgtgaatgttgagggggcgacacacaagcaggtggtggacctgattcgagcaggcgagaaggaattgatcttgacagtgttatctgtacctcctcatgaggcagataacctagatcccagtgacgactcgttgggacaatcattttatgattacacagaaaagcaagcagtgcccatatcggtccccagatacaaacatgtggagcagaatggtgagaagtttgtggtatataatgtttacatggcagggaggcagctgtgttctaagcggtaccgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagaggaatattagttagagactgattatctcatgtgagccaggacattcttccagcaaggttggcctctggatggtgaacgggctgtgcaaaaaagccctgcttcttcccttgtctagagggtggacattggctacaggctcttccatctctcatgacttcatggaccctcctctgccagttttttaaatcagatcaccctccatgttgttcctgacccacaggggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacagaatttggaagattctgaataattagttacttattctcaaagaaaatctttgaaagaatcaggaggtcaagtcaagaacatgaaaatttatattttagtacagtagaaagaacattgggctctgggaattttatctgggttttctcctggcttttttttccctctgtgtaattttgggtaaatcagcctccctagctttcagttttctcttctgtgaaacaggaagactgaaccacgtaattaatatccaaggtcccttccggctctaaaaggctatgattctagatgagaagttatatcaagaaagatgtggccaatcagattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgccttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaacgcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaacacttctttggtt

SEQ ID NO: 185069 - DNA, 6403 bp, Homo sapiens
  Payload ID: 16437
  Gene Symbol: SNX27
  Gene Name: sorting nexin family member 27
  Uniprot ID: Q96L92
  ENST ID: ENST00000458013
  CDS Start-End: 121-1746
tcccgcggccggcggatcgggcgcgcgcgtcgggggtcgtccggctgccaggcagggcgagcacgcgccgggaggccttggaggcgtagggggcgggggtacggctcgcctgctcgcaagatggcggacgaggacggggaagggattcatccctcagcccctcacaggaacggaggtggcggcggcggcggggggtctgggctccactgcgccgggaacggcggcgggggaggcggcggcccgcgggtcgtgcgcatcgtcaagtccgagtccggctacggcttcaacgtgcggggccaagtgagcgagggcgggcaactgcggagcatcaacggggagctgtacgcgccgctgcagcatgtgagcgccgtgctgcccgggggggcggccgatcgggccggggtgcgcaagggggaccgcatcctggaggtgaaccacgtgaatgttgagggggcgacacacaagcaggtggtggacctgattcgagcaggcgagaaggaattgatcttgacagtgttatctgtacctcctcatgaggcagataacctagatcccagtgacgactcgttgggacaatcattttatgattacacagaaaagcaagcagtgcccatatcggtccccagatacaaacatgtggagcagaatggtgagaagtttgtggtatataatgtttacatggcagggaggcagctgtgttctaagcggtaccgggagtttgctatcctacaccagaacctgaagagagagtttgccaactttacatttcctcgactcccagggaagtggccattttcattatcagaacaacaattagatgcccgacgtcggggattggaagaatatctagaaaaagtgtgttcaatacgagtaattggtgagagtgacatcatgcaggaattcctatcagaatccgatgagaactacaatggtgtgtccgacgtagagctgagagtagcattaccagatggaacaacggttacagtcagggttaaaaagaacagtactacagaccaagtatatcaggctatcgcagcaaaggttggcatggacagtacgacagtgaattactttgccttatttgaagtgatcagtcactcctttgtacgtaaattggcacctaatgagtttcctcacaaactctacattcagaattatacatcagctgtgccaggcacctgcttgaccattcgaaagtggctttttacaacagaagaagaaattctcttaaatgacaatgaccttgctgttacctacttctttcatcaggcagtcgatgatgtgaagaaaggttacatcaaagcagaagaaaagtcctatcaattacagaagctatacgaacaaagaaaaatggtcatgtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggagaaccaggtaattgcatttgaatgggatgagatgcagcgatgggacacagatgaagaagggatggccttctgtttcgaatatgcacgaggagagaagaagccccgatgggttaaaatcttcacgccatatttcaattacatgcatgagtgcttcgagagggtgttctgcgagctcaagtggagaaaagagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctcactcctggctttctagccacattctgcacctccttcctgctttcctagagcctcggtatgctttccctcaaccgaccctggctcaggaggttgatgccatgggaacctgaacctgaaacacttcatggtagtaatttcctgttttccttgccttttttttttttttttttttttttttctgagacagggtcttactctgtcgcccagactggaatgtggtggcatgaacatagctcactgttaccttgaattctgggctcaggtgatccttccgcctcaccctcctgagtagctgggactacaggtgtgcaccaccacacctggctaattcttcttaaaatttttttgtagagacagggtctcactatgttgcccaggctggtctcaaactcctggcctcaggtgatcctcttgtctcagcctcccaaagtgctgggattacaggcatgagccactgtgtccttccctgccttttttgcagcagggatagtactcaggaccagagttaagctgataccttaggcacacaggttggacttacatagaggaaagaaagcaagaaatgccctatgtacatgaggttttacctcctccattcctgaccaataaccacccataactacggcattctctgtgacttccttaaacagcagtgatgggaagggatccaatagtatcttcaaggccttggggaaacttgcagtgggtcagtggtctgtgccaaccaaacgatagccccatccaagccagctgagaacctaggaaggagtagtaggaatatggttgattagattggatctcccaagttttaattgaaaggagactgaacgaaaacctttctgctttctgtccgttaaagagctcctcatctgatcttgcagctagaccctttgagacttaagagctgcatcccaggatcagaagccagggctaattggggtaggacaatattcccagcccctaagctctgtagataatgcataagaagcaccaagtcaggctcagatgcaactaaaacacatctttgagccttttctttttcccttctcccctttctaaacaaaaaccttcctaggatggcatcttttgctctaactgggagacagtcataattggttgtagtcaattctactaagcagtgttggggtggttggaaagtctcttttttgtaatttgtttttgcaaatcattgtgaggccactttttctttctttctttctttctttctttctttctttctttctttcgttctttcgttctttcgttctttctttctttctttctttctctttctttcttttgctttccttctttcatctcttttttgtaatttgttgttgcaaatcattgtgaggccacttttctttccccttccttccttcctttttttctgttttttttttttttttttcccagagtcttgctctgtcgcccaggttggagtgcagtggcacgatctcggctcactgcaccctctgcctcttgggttcaagcgattctcctgcctcagcctcccaagtagctgggattacaggcatacaccaccacgccccactaattttttgtatttttggtagggcggggtttcaccatgatggccaggttggttttgaactcctgacctcaagtaatctgcccacctcggcctcccaaagtgctaggattacaggagtgagccactgcgcctggcccacttttctttctttccttcttattttgttatgctggcagccatttgcccctgcatggtatgggatcaaagaggacagcctttcctccctcaccttctccaaatctaggtgaaatcacagagtacaaaacgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaacgcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgat

SEQ ID NO: 185070 - DNA, 7622 bp, Homo sapiens
  Payload ID: 16438
  Gene Symbol: SNX30
  Gene Name: sorting nexin family member 30
  Uniprot ID: Q5VWJ9
  ENST ID: ENST00000374232
  CDS Start-End: 165-1478
gccggcagagaccagccggcgggtggcggcggcccccagcacggccggtgcaaggcctcgggttaagcggcggccgagcggggctcggcccggggtgctcggggagctcgccgcggcgggcagcaggaggaagcggcggcggcgcgtcccgagcggtgcgcgccatggcgggcgggccccccaaggccctgccgtccacggggccccactccctgcgcgacatgccgcacccgctggccggctccagcagcgaggaggccgtgggtggtgacagcacgcccagcccggacctgctgatggcccgcagcttcggtgacaaggatctcattttgcccaacggtggtactccagcaggtacttcaagtccagcttcttcatcttcccttctcaacagacttcagcttgatgatgatattgatggtgagactagagatctcttcgttatagttgatgatcccaagaagcatgtgtgtacaatggagacttacatcacctataggatcaccaccaaaagtactcgggtggagtttgacctgccagaatattctgttcgtcgaagataccaggattttgactggttgaggagcaaactggaagaatcccagcccactcatctcattccccctcttcccgagaagtttgtggtaaaaggtgttgtggatcgtttttcagaagagtttgtggagaccagaagaaaagctttggataaatttctaaaaagaattacggaccatcctgtgctgtctttcaatgaacactttaatattttccttactgctaaggacctgaacgcctacaagaagcaagggatagcattgctgaccagaatgggcgagtcagtcaagcacgtcactggcggctacaagctgaggactcggccgcttgagtttgctgccataggtgactacttagatacatttgcactcaaactgggaaccattgatcgaatagcccagcggatcatcaaagaagaaatagagtaccttgtggagctgagagaatacgggcctgtgtactccacatggagcgccttggagggtgagctggctgaacccctggagggtgtgtcagcttgcattgggaactgctctacagccttagaagagctgacagatgacatgacagaagacttcctacctgtgctcagggaatatattttatactctgactccatgaagagtgtattgaagaagagggaccaagttcaagcagagtatgaagccaaactggaagctgtggctctgcggaaggaagaccgccccaaggtaccggcggacgtcgagaaatgtcaggatcggatggagtgtttcaatgctgacctgaaagctgacatggagaggtggcagaacaacaagaggcaggacttccggcagctactcatggggatggctgacaagaacatccagtattatgagaagtgcctcatggcgtgggagtcgattattccactactgcaggagaaacaagaggccaagtaaagttctttcttgggacggagactcttctacctacacagggcctggcaccctataccggaatgtccctgcagtgccagagacgcagtgctgggaaaacaaccacagaaacatctctcctttgtgtatttttccctcccccacctttcaccccacagtggttttcaattagtatttattccatggtggagtctgtgaggctagaatatctctcagcaagagcagcatacctccatgttgtgaaggcatctgttcagtgaagcactacgaaaatttgaaaccaagggacaagacaacctgcagctgacgctctgacatttcatgacagtttcctctttagggacagctgagttgccagttgtgggagagaacccggggcctgcttttcaaggatgaggaggaggcaggaacagaaggcagctgctgctttctgtggaaacctggcccctctggaattggcctctgtgggcattgactcgtcttggcctaggaggcattggtgcctccctggcaagtccttaacgtacagtacctgtagctgtgagtgtggcctgctgcctgcttgtgatgagtgataccgtcttactgtttctgtttcacatagggacatttaaatcaatgtcaatgtgcgtccatgcttgagtgagcaagccagcgtccttgtcctcctgcaatgcctttgggaagctcaggggaatgctccccaagcttgtttctgacactagaatgcaacagattggaaactttttgtgtaaaatgaaaaaaacaaagtgctggttttttttttttttctgtgaaggtcttcagtgttttgcttgttcactgtcatcagagcagggattagacctgttagggaatatctattgtcttgaagtcagagtagctccccattgttgagatcagtgggcatataccaagctccacccccagtgtcagctttgtgcaatttgcctttacctcaccaaaaatacctactttaatatttcctcctgtgtcctctgaatgtctgggcgagcttttggtgagagggctggtatgtcatgttgttatgatacagtcgaaatttgtcaatgcagtgtgaatgttctacataaagtgctttaacccttaacatttcctggtcaggaaggaaaatcagtacctggacgggcctcgaaaatgacaaatgcaacagcgagccctttgtgtccagctaagctaaagtctcctcagtgtgcagccagattcctggggactgctgagtgtggttacaggctgcatttcagacaatgaccaggtttacttttcagatcacaaagcaaacagtcaccaaggatctgtcttccaactcttttttttttctgctgaaatgaagctacatgtcatgtttgtgttctttcatctgtggctcatccctgtaaaactacgaatctgagcctcaaataagcagtagtttttttgttgtttatttttaatgaaacagctgtgttaaggcgctgcttcagatgcaagttcacctggaaatactggtcagcgggcagcacgtcaaggtcacttaagcccacttttaactgcaggtcatcctcgcatcagccaaggctgtggtgctgttgatgccgcagttggacagcataggacggcttggttctgtttcattgtgtttgacaatgttgcagtttaaatgataatgtttaaatcaattggtacttgcctgtagtgttaaaccctatttgtgccattctcaagtcctttgatgtgaattttcagtttggtacagttagaaatgactcattgatgcggacaggtaagaacaacccatgtacccccgagtgattgcatgctttattctacctctaagccatcgtgttgacgtgggtatggacgcctgggtctgacctgacactgtgctgggagaatcaggatgtgtgtctaatggcgagctgacagccctctgctgatatttggcagaaggcaccagaccagcccagcagcaaatgctcatctttgggaacataggaagctttaccttggggaaggtatgctttacaaatgtccagtgtaatgaatgtttggaaaaaactggagttacaggaaaatgaaatctgactatctgctagttgccaaaacccagaaacattcctgtgtaatggttagttgggaaagaaggcagcacttgaaaaaatttaccaggttcctcactgggagatgtgggaaggggcgtgggacgcacgcggtcactccctctcctagtgagaggcagatggctggctctgaagggaggcaggcaccgtgggatttgggcttgctctgcttggtccccatgtgatgccctgtgctgtaagatatcagaaagacctggaacaaggcaaactttatgtcctcctggcatgttattgataacagagccaggaagtccagtgtacattacagattttctgggagaaatagtccttccagagaaaggattccttcccagcctccaggctggtgtctcatgaggtgaggaggctggcccagaaggaaggggacgttaggtggtgaagcaggctcccctgggcctctgagggccagcagtcccaaccatttgcctcttcgttttgaccaagcacaaaagagatattccctagaagtgtcacacggaggcttctgtgccaaagactgccttgtagaggtctcatcacctcacacttcttgacttcacaaaattgtggccctgagatcagtactcctctcttaagtatttattattattattatttactttacctcaagcagacagacataggttttgaggcttgaatacatggcagtggaatacaaggccctccctagcagccgccccaggcctggaaagtgggagatttcattcgcccgggttaaaaatccagaggaagacagaagagaggagtcctaggaactgagcagattttagagacgcaaatgatgtttaagagagccttgtgatttgtagcaagcatgggcactgctttttcttactaatgtggtagatctacacgaacattctaggctgttctgctcagagcgaggaaccactgctcctcaatggggagggaacataccacccagccaggcttagcattgggttttatcctttaataaaagttttataatgaatcctgttcaccttaaagtgtgattatggagatgattggctccatattccaccacgtcattccttcaactcaccagacacctttctttagttgaaataaaccagcatgacctggagatcatggtgactgtaagctaagtctgttttcatgccagatttcagccccacccagagtgtgctctagatgttgttgatttgaatggttttcccagttcccactccacatggggaagttgaatgaatgcacacctgctgctcacttcttgtgaggctgccttttgtgatcaaataacaggaagttctgctttagaggagggcacgatgaccatgtggcagtctgcaagtggaattttgggatggcagcccgaggaacatccagagttactgtgtgacttggtcctgccatcgttagctttgaaatcacaggcattgggctctgttttgacaccattcattggactgcgggacagtcattctttacgttctctcttgagctggtgagagaggaggaagagggaagtcaagagcaacctccaaggcctatgtcagcctcttctccttgggtcttggggtgggttagaactgggttccagtctggccagatgggttgctggctgcactgagggtgattcttctcagaagatgggctgcctgtggtcaggacagggcataccagtctggactccaccttcccagacacctactttaaggacctgtggaaactgggtgatccaattatagggctggggcaaccctgctttggccaccctcatttacaaacttaggttgggagcttgggtttcctgtctcacttccaaaagccttcaagatggcagcagatggacacaccctctcatttcttgtgtcttgtctgtcagatggcaggaggcctgtatcagtaaatttgaggaaaatgttctctcctgggccagcctcacagcttgcgttgggtgtgttggaattgttctcttcggccttgttctgccttgtgatcttttcaattcagtgaataaaccaggaatccattttttcaccaacccaccctgtagattgtcagctttttgtttgagagatgcctggtctcacagttacatgtatcagagtgtgtgtaagttgtctgtgttagaaaggttggggtgggggctttgttgcaggggattagactgttctttcttcatcataatttgagatacatcctgagtatgactgtctaaccctttctgtgtggcagaaaaatatgttttccaggtagtttttactactacagagagtctgtaaataagtgctttaaaaaaataacaaaccaataagatatttgtctcctatataaacattctgtgtatttagcacttgaaaatcaacaaatccagaatttaaaaaaatgccacagacttttcaaagcccaactctacttttttgagaatttgtccgtacctactaatatgccttattcttcttcacctagtgttttaaaagtcctgggtagaaagagttttagaaatgtaatcagttgttcagcttcaataatatagagatctaacatagtcagtcctcaggccccctaaagaaacaagcaagaaagtgagggccatcactagggttggctttggggaggggaaaactaaggactgcttttgccaaatgatatttttgataatgtaaggaaacacagggaccacaaaaccttttttttttttttaagtgtgaaagattagtgccttttggcatacttttgattttagaggatatagtatcggcattgacaaatcacgtagaaacaaagaatgctatagatgacaacagtattaaatgttactcctgattctgcagaacagcttttgaagatactggggggtatcttcaagcctcagagcagcttgtttcagatagaaattctctatgggttgaaatgccaaaaacagaaaacatgatgttgactcatgtaatttagtccattttagcagagcctttagtgttaacaccagtggcgaggagcattgcatattctctgtcagcagcagcactcccacaccaggtggttctgggctctctgtaggctggtcctagtaggtgacacccagcaacacccctgttggacaggattgattgttcgcagtcttagaccaacacttcagtcagaaatgttactgggaggaggaaaggaaaatcactttttttcctccatgtggaaatgaggagagaggaaagtggattgcaaaccaaaatgtgagtcagtgtgatgaagcagtggctctgtcatctcggcctttatccaataacaaaccagcatctcttaaaggcgcttttggcctagacacccctgaagtttggatgaagtctggtggattccctgtctgttgtatttctgtgtgcctgttcccttcattgctgtgagttgggagtgcattgagagatgatgtccatctgatatattcctgtgaaataaactgccagcaaactttctaacttgtattttaactgttaaagaagagattaaaaacttcggctttggacatgtccacattatggactgtcatcttatttttaaaagtcattctttacgtttaaaattttaaaataaaaaccttctgaggtattgatgtagtccaccgtgtaaatgttaccttctctccatgctgccattatgccaaaacaaaagctgtgataaaaaaagtgcttgagagagtgtgttgataagaaagtgatttatttacagatggaagtctttgtttcatgaagctaccaaactttaaaaagaatgtcacccttttttttgtttgttatggaaaccagagattgtaaaatggaaaaagaatcgtttttttgttgactttttgatgctggcacgaggtttttgtccacttttttcatatatctgtgtataaaaaaattgttgtttactatggaattagtattacattttgaggtaaacaaaagaatttgtattgcttgataaatattagcttgtaaatttaaagtttctttacttcaattaacttaaaggaccaataaacccataaaagatgctttcttta

SEQ ID NO: 185071 - DNA, 394 bp, Homo sapiens
  Payload ID: 16438
  Gene Symbol: SNX30
  Gene Name: sorting nexin family member 30
  ENST ID: ENST00000416585
  CDS Start-End: 1-374
tgtcagcttgcattgggaactgctctacagccttagaagagctgacagatgacatgacagaagacttcctacctgtgctcagggaatatattttatactctgactccatgaagagtgtattgaagaagagggaccaagttcaagcagagtatgaagccaaactggaagctgtggctctgcggaaggaagaccgccccaaggtaccggcggacgtcgagaaatgtcaggatcggatggagtgtttcaatgctgacctgaaagctgacatggagaggtggcagaacaacaagaggcaggacttccggcagctactcatggggatggctgacaagaacatccagtattatgagaagtccattgcagatctgaagtgatggcctagggagagagcagg

SEQ ID NO: 185072 - DNA, 3211 bp, Homo sapiens
  Payload ID: 16439
  Gene Symbol: SOWAHA
  Gene Name: sosondowah ankyrin repeat domain family member A
  Uniprot ID: Q2M3V2
  ENST ID: ENST00000378693
  CDS Start-End: 36-1685
acccgccccgggagccaggaacccagggccccaccatggcgctggccgccgccgccgccgctgcggctgccggggtgagccaggcggcggtgctgggcttcctgcaggagcacggcgggaaggtgcgcaactccgagctgctgagccgcttcaagccgctgctcgatgccggcgacccgcggggccgcgccgcccgcagggaccgcttcaagcagttcgtcaacaacgtggcggtggtgaaggagctcgacggcgtcaagttcgtggtgctgaggaagaagccccggcccccggagcccgagcccgcacccttcggccccccgggggcagcggcccagccgtcgaaacccacttcgacggtcttgccgcggagcgcctctgccccgggagctccgcccttggtccgggtgccgcggccagtggagccgccaggggacctgggtctgccaacagagccacaggacaccccgggggggccggcctccgagcccgctcagccgcccggggagcggtccgccgacccaccgcttccagcccttgagctagcccaggccaccgagagaccctccgcagacgcggccccaccgcctagggccccttctgaggcggcatcgccctgctctgatccgccagacgcggagcccgggcccggggcagcgaaagggccgccgcagcagaagccctgtatgctgccggtgcgctgcgtcccggcccccgccacgctccgcctccgggcggaggagcccggcctgcgccggcagctgtcggaggagccgagcccgcggagctcccctctgctgctgaggcggctctcggtggaagagtccggtctgggcctcggcctgggcccgggccgctccccgcacctgaggcgcctgtcgcgcgccggcccgcgtctgctgagccctgacgccgaggagttgcccgccgcgccgccgccgtccgcggtgcccctggagccgtccgagcacgagtggctcgtgcggactgccgggggccgctggacccaccagctgcacgggctgctgctgcgcgaccgcggcttggcggccaagcgcgacttcatgtctggcttcacggccctgcattgggccgccaagagcggcgacggcgagatggcgctgcagctggtggaggtcgcgcggcgcagtggcgcaccagtcgacgtgaacgcacgctcccacggcggctacacgccgctgcacctggctgcactgcacggccacgaggacgctgccgtgctgctggtggtgcgtctgggtgcccaggtgcacgtgcgtgatcacagcgggcgtcgcgcctaccagtacctgcggcccggctcctcgtacgcgctgcgccgccttcttggcgatccaggcctgcgaggcaccacggagccagatgcgaccggtggtggaagtggcagtcttgctgccaggcgccccgtacaggtggccgccaccatcctcagttccaccaccagtgcatttctgggcgtcctggctgacgacctcatgctccaggacctggcccgaggcttgaagaagtcgagctccttcagcaagttcttgagcgcctcgcccatggctccacgtaaaaagacaaagatccgcggtggtctgccagccttctcagaaatctctcgtcgacctactccggggcctttagctggtctagtgcccagtttgcctccaacaacctgaaggtccctggggctaccacctggttgatctatcgtggcctgctcgtcgcagtccaaacccgcccaagactgcagcccaatcaacgcctggagcctcattctgtttccagctttgtccagggcagcctgttttacccagatgggcctgcacctccagcttctttctgaagcatgacccatctccagagatgggatttgagaaatcagtgagagcttcctataaagaactccaggagacaggcctgaactctagagggaacttgaaatccagggtcaaaggttaaggggcagcagctggtctggcccctgaaagccttcacctgatgcctctgcagctacacaatcccaagacagagctagagcaagggtctctttaaatgttgaaagatgttaggttgtcagctttaagatatgtggtggttttgtaatttgatgcttttattctgtttttaaattgaaatgaggtaatgcaactttcgtaataaccttttggaattatatttttccacttttaggcaaagtgcttagacattttcaattttttttttgctaaatactttggaattctatttaaaaaatagatgatcaagatctaaaggaaattaatcccaaccaacaaacttaaaagtttatctacctcgttttaggcaatcaagattctggagagtcttgaacacagaataacgattgtgaccattatgaatgtaactaatttcagttgtactgtgaatgctaaatatttgcaaacaagtacatcttgaaagtaaaggtgacttagagaaaagagacattttgacagatacttttaatttgtggttgtctccatcatgaaatagaaacgtgtttggcacttgtgggtggctattttgatttggcatgactacttaattttttaaaaaaattgtggtttgtgaattgcacctttgtgccatgtttctgaatctggttttcaaatccagtggagcctttcagtgaaataggtgactattaaaaaagtaatagtattacagaaaaatgagcgattaaatagtaatggatacaattaaggagcaactattttatatgactgttctgtacaaacaaaaagtatgtaatacccattttaaaaaaccatttgaaagtagacaacttattccaaaatagcaaatgcagaatctctgctcagtgagcttggatgagtggcttaacttctctgggcctttgttcctatctgtaaatgagaaagtttgtagatattgccaagatttcccaggctcaatacagtgtaattattttatgttttaaagatatgaaatctgtttactcaaccaattttttaaatgtcatattgtgataatgctctgcttttgcaaattgtgtttgcatgtcattagttatatcaaatagttttgtggcatggggtagtggagcttccctccccacccccatatgtatcagtgaagcctttgaaattacttaaggcagtctttcatggaatgttttgattgagcaatgaaataaacagtcctccattttgtttctgcttga

SEQ ID NO: 185073 - DNA, 3220 bp, Homo sapiens
  Payload ID: 16440
  Gene Symbol: SOWAHB
  Gene Name: sosondowah ankyrin repeat domain family member B
  Uniprot ID: A6NEL2
  ENST ID: ENST00000334306
  CDS Start-End: 299-2680
gggaactttcgctgtgaggactcgttgcgagaggctagagtcgcgcaggggcggcctcggagccgccctctctcacgcagactgccgcggggactcagccttggggccacccggaggggacccacggccctcctggcgcgctcacgggctgcgggcagcgctggcctccgcggctgatgggggcggctagtgccgccccgggcgcaggtgacactcgcccggccagggtttcctctggctggggagagccccgggagggcgagactcagacacctctggggcggaggacaaggcagcgatggcccgagagctgagccaggaggcactactggactttctgtgccaggctgggggccgcgtgaccaacgctgccttgctgagccacttcaagagctttctccgagaccccgacgcgtcccccagccagcaccagcaccgccgcgagctcttcaagggcttcgtcaactcggtcgccgcagtgcgccaggaccccgacggcaccaagtacgtggtgctcaagaggagatacagggaccttttgggggaggaggggctgcagcgaccccgcgagccgcccgcggccgcccccagtgcagggggagctgcgccctgctccccgcgaggcgcgcgccggggggagccgccccagcagcagcccaggcggcggcggcgcgagaaggagccggaggaggagccagcaggtgcagcagccagagccgccgacgcagcttgcaatggactcccgggcagcgactcccgtagggcgcccgggaagggcggcggatcgaagggcagtcccggacagaggccgccggtgcccgcagctgcagcggcaggggcccaggcgagagcgagctgcgcggcggcgaagacgcagggccgctgctgctgggaatgcctccagaacaacctggctgtactgccgggagagctcggcgcactcccgcactcggccaccgcggaggagaagccggcacgggctctgcctgcccaggatgaccgcggggcttccagggagcgggaagaaggcgcgctagctgagccggcgcctgtgcctgcagtggctcactcgcctcccgccaccgtcgaggctgcgacaagcagggcttccccgcctgctctcctgcccggccccgctccccgcggagaccggccggagctgctgacccccagctccctgcattattcgaccctgcagcagcagcagcagcgcactcgagagtgggtggccaggcacccgcaggtgcccgaggcccgtgatcagggccctatccgcgcctggtcggtgctgccagacaacttcctccagctgcccttggaacccggctccacggagcctaattcagagccgccagacccctgtctttcctcgcactctctctttcctgttgttccggatgagtcctgggaatcctgggcggggaacccttcattgactgtctttcgcagcattcgttgtcagctgtccctccaagatctggatgactttgtggaccaggagagtgatggcagtgaggagagcagcagtgggcccaaagactccccgggggcttctgaagaggggctgcaggttgtcttgggaaccccagatagggggaagctcaggaatccagctgggggcctttctgtatctcggaaggagggcagccccagccggagccctcagggtctcagaaacagaggggatggtcacatctctcagcaggtccctgcaggggctaatggccttgcaggccaccccctgaagcctttgccttggccagttcctaagttaaggaggtccctcaggaggagctctctggcagggagagccaaattgtcctcctctgatgaggagtacctcgatgagggcttgctgaaaagaagtcggcgcccacctcgatccaggaagccctccaaggcaggaacggcacccagcccaagggttgatgcaggtttatcactaaaacttgcagaggttaaggctgttgtggccgagcggggttggcgacacagcctgtgggtccccagtggggaggggtctgcagccttggccccccacagaacttctgagcacaaatcatccctggttccactagatgccagggagcatgagtggattgtgaagcttgccagtggctcctggattcaggtgtggactttgttctgggaggaccctcaactggccttgcacaaagactttttgactgggtacactgcgttgcactggatagccaaacatggtgacctcagggcccttcaggacttggtgtctggagcaaagaaggcagggattgtccttgatgtaaacgtgaggtccagttgtggatataccccgctgcaccttgcagccattcacggccaccagggggtcatcaaattgctagtgcaaaggttggcttctcgggtaaatgtcagggacagcagtgggaagaagccatggcagtatctaaccagtaatacctctggggaaatatggcagctgttgggagctcctcggggcaagcccattttccctgtctatcccttagttggaagttcttcccctaccagaaaggccaagagcaaggaaatatctagaagtgtcacccgaaaaacttccttcgctgcactactcaaaagtcagcacaacaagtggaaactggccaaccagtatgagaaattccacagtccaagggaaagagaagagtatagtgactgaggtgggtctctctgtccaacatgcaggcagcactccctcatcctgctcagtgagagaattcagggggaatagaaaagctgctgagagttggtaaagaggatggtcgagtgagatggtgttgacctccctggatcttatgtcactacatcctggacctcaagagggtcatccaagctttttgaaagctgaactccttgactggagaaacctagacaagaggcggggccaggtgcttgatatctaggaggcattcttcctcttcccttgccaccatggagctgggcacagtaagccatattgtttcctgaagcaggagtcccaggccttggctagagagggaacagatgtctaacaaaaagagaagcaattcgaggaattgatgaagcacaattaaaatcctctctggctagtagctctctggcttctgttcatttgaagaataaatcttggctgacagtgggaagcaccaggtttgaaatcagatggctttatttttctttttttggcatttaaatcagtgaaataaaattattactggag

SEQ ID NO: 185074 - DNA, 4657 bp, Homo sapiens
  Payload ID: 16441
  Gene Symbol: SOWAHC
  Gene Name: sosondowah ankyrin repeat domain family member C
  Uniprot ID: Q53LP3
  ENST ID: ENST00000356454
  CDS Start-End: 157-1734
agtgaggcggtggccgagtcctctggcctcagacgcgtaggctggcagcccgctgagcccgccagactccgccgccgtcgggagccggccgctgggagcccgtcgctatgggaccgcgctgagccgcccgctggcgggggagcagcgcggtcgaggatggaggggccggcagagtggggccccgaggcggcgctgggccccgaggcggtgctgcgcttcctggcggagcgcgggggccgggccctgcacgccgagctggtgcagcacttcaggggcgccctaggcggcgaaccggagcagcgcgcccgcgcccgcgcgcacttcaaggagctggtgaacgccgtggccactgtgcgcgtcgatcccgccgacggcgccaagtacgtgcacctcaagaagaggttctgtgaagggccgtccgagccctccggggacccgccgcgaatccaggtgaccgccgagcccgaggcccccgacggccctgccgggcccgaggcgcgcgatcggctccccgacgcggcggccccggagtcgctccctggacagggccgcgagctgggcgagggagagccccccgcccccgcgcactggccgcccctgagcgccggggctcgcaggaagaactcgcggcgcgacgtgcagcccctaccgcggactccagccccggggcccagcgaggacctggagctcccgccacatggctgcgaggaggcggacaggggcagctcccttgtgggggctaccgcacagaggccggcccgccagaacctccgtgacctggtgatgggcagctccccgcagctgaagaggagcgtgtgtcccgggggcagcagcccgggcagctcctccgggggaggacgcggcagaggcgggggcgactcagacagcgcatcggtggcctcgtcgtccgcggaggaggagagcagcggcggaggctccgtgacgctggaccccctggagcacgcgtggatgctctctgcctccgatggcaagtgggacagcctggagggcttgctcacctgcgagcccggcctgctggtcaagcgggacttcattaccggcttcacttgcctgcactgggccgccaagcacggcaggcaggagcttctggccatgctagtcaacttcgccaacaaacaccagctgccggtgaacatcgacgccaggacgagcgggggttacaccgccctgcacttggcagccatgcacggccacgtggaggtggtgaagctgctggtgggggcctacgacgccgatgtggacatcagggactacagtgggaaaaaggcctcccagtacctgagtcggagcatcgccgaggagatcaagaacctggtgggagccctggacgagggtgacggggaaagcgccgcgggtagcggcggcgggcgctggaggctttcaaaggtgcttccctcgcatctcatcacctacaaactctcacacgccctagaagatggaggggaccatcaccaccatcaccactcggctgaggggtgggtcggaggcaaagccaaggatccagggcgcaaagcctcgggcagctctagtggacgtataaaacccagactcaacaaaatccgattcagaacccagatcgtccacaccacaccctctttcagggacccagagcagccgctggagggcaggggggaggagggagtgggggaggaacgacctgttaaaggccactcgcccttcacattgagaccaaagtccaatgtatttgggtaaaaattgcttcttttagaaaatgcaaaggtttatttgtcttaataaattgaatactaggtgttgtaaggaagtgagaccagaaggacaagctaaattatgcattcttacttgagggatcggaatggatggggcggagttctcttcaggctagccttctgggaaaagtggatgtctttttcagagattcatcataccttgacctgtacctcttctctgccctccacttccctgccctggagtccgtttctggagactagaaatgtatctaaattgggggaacagaatgaatgaattaatgaatgagagttcctttgctttaaccattcctggatgcctgcaaagtaaggaataatgcagtttttatgtatctgattttataaggggttactctttcaagagtaacaaaaaaatgcaaactgtaatgaaactacattgtatttctaagtgtgaaaacgacaggctgccccgtttttactaattgcatttgcattttaaggtactactgaaggtcagatcaaagttgaaatgcaaaaatactaattagagaataatgtgaataaaatgggaatcttcttggtattttatgtgtattgtaagtagcagttaaattatttttttaaaagcaatttcagttttaatcactgaacaaaagaaacaggcaacattcacttctgtagtatggtttccacctatctctaacaccactattaaggtacaccagtgttaaggtacattaataactacacaaaattttatttaaagagaacacttagcagcctatgatagttttcaataaaatgttgcctctctttcggattctcactaacttttgttactattctaaaagtttgaatttgctggggtgtttattctgaggattatttaaccattgttctatttggcataaccctatttaatggtgcttagagctgaattacctacagaaactgtttctggtttaaataattagcacaaattggcctaagtattcatgagcccatgtttctgtgaagtaattattaaaccaacttaatgattcttatgtaaggtacactttttattttaatacattggtagtctctatgacttgtagcaatgttttacaaatgtttaaaatgctaaacttaattttccaagcttttcttgacaattagatacctatcctgtagttactgaaaatctgggtagtaaatctacccaattaaaatggcactttataaaagggaatagagaagagatgggactatttctatatttaaatgctgctggctattcctttgtatataaatgaaaaataccattcattaaaattaagtactcgtttaagtatggttcttaattacatttcattcatttatattagagtaaatggcttcataactactttaaaatttaacccacaagcatattaaatctgtttgttataagattggaaacaatttttgagagggactaatttaaacaagtcctcctttagtcttttgggtcgcgtagttgctgaaacctaagtacctgcagcctacaggataaggaagttcacagcctgcggggtgaatgaacccatgtgtgaactgcacagagcaattcatagaaaatgcatagaaatttgtaacactttggtcacatctgtctctagatggtcattgaatttgtttaaagatggatgaaaggccaggcatggtggctcatgcctgtaatcccagcactttgggaggccgaggcaggtggatcacttgaggccaggagtttgaaaccagcctggccaacatggtgaaaacctgtctctactaaaaatacaaaaattagccgagcgtggtggtgcgtgcctgtagtcccagctacttaggaggctgaggcatgagaatcacttaaacctgagaggtggaggttgcagttgagccaagatcacgacactgcactccagcctgggcaacggagactctgtctcaaaaaaaaaaaaaaaaaagatgaatgaaaatatgaaatatataaactagtatccatttatttgcatttattgtgggatttcagatatgaacggtgtaaatttgagaagcacttatgcatacatgtgggtgaaaaaccaatctaattttgtataaataaaaacaggctcctggaaggtgaaaagtagtcatttgttctaaatctatacatattacttgtatctagtgcagaataagctataacatcccattgaggaatcttaaatttcatagacatgtaaagctgaagtaactctaaagagcagatgcttcagaaccatcagaaggttctggtcaacagtcagtattatctcttaaatgtatatgttggtcactaattgcacaaaatctataatttgccagggctttagagattgagtcaatatgtcatttaccatggttttcccactgaaggctttaacttttctgataaaataatattttaaattttcaaaaacccattcctgaggagaactacttctagcattccttttcatgatgtgcttttgtgcagtaagtagcattttcggctacttaactttacattcctcttatttttcagtttccagtcaagattataaaaagcaaatgattgatataatttgatattcatagagttgtgcctacctttaatggaaaaatacatgtcagatacttagatgtttattgatatgagactatgtggttaaaaaacccaagtatgtccatgtgtttcttataaggtacacttgaaactagtgagtgtttgtcacatttcactttcatggtatataaaatgcagtttgcatatataacttgaatatctggtactagttttttcacgcctgcaatcttggagtctaggttgccttgtctctcctatttttaaataagtgaaatttgggagattgtaaaatctgtaaagtttgttttgtgaaaataaaatgttcacagtagaa

SEQ ID NO: 185075 - DNA, 1552 bp, Homo sapiens
  Payload ID: 16442
  Gene Symbol: SOWAHD
  Gene Name: sosondowah ankyrin repeat domain family member D
  Uniprot ID: A6NJG2
  ENST ID: ENST00000343905
  CDS Start-End: 56-1003
gggaagggcagctaacgctggacactgggacggccgcggcggcagcttcaagaccatggcccagctcggaggggccgcgaaccgggcacccacggcctctctcgcgccgacctcgcagagcctgcggtgcgccccgcagccccgcccctcgagagcggacactggtagcctgggcaggtactggggcaaagccgcagccgccgcctcccgggagcaccccttcccaggcacgctgatgcactctgcagcgggctcagggcgccggcggggagcgctgcgggaactgctggggctgcagcgggcggctcctgcggggtggctgtcggaggagcgcgccgaggagctgggcgggccgagtgggccgggcagcagcaggctgtgcctggaaccgcgggagcacgcgtggattctggcagccgccgagggccgctatgaggtgctgcgggagctgctggaggctgagccggagctgctgctgcggggcgacccgatcaccggctactcggttctgcactggctggccaagcacgggcgccacgaggagctcattctggtacacgatttcgccctacgccgggggctgaggctcgacgtgagcgccccaggcagcggcggcctcacgcccctccacctggcggcccttcagggccacgacatggtcatcaaggtgctggtgggcgccctgggtgctgacgctacgcgccgcgaccacagcggccaccgggcctgccactacctgcggcccgacgcgccttggaggttgcgggagctgtcgggagccgaggaatgggagatggagagcggcagcgggtgcaccaacctgaacaacaacagcagtggcaccactgcgtggagggccgcgagcgcagtgggcgcgacggctgtggagacaagcaggagagtggcagcgtcgcggaccaaggcgaaggacaccgcgggcagccgggtggcgcaaatgcatagccttttccgccatctgttcccctcattccaggaccgttgacagggacagagactggagagctaggaggggctgtgacactgtggcgatggctaggtcctgggttgtcccgggttccaccgaaggagaggcgccttggacgctgcttgggcctgcaaggaacagaacacgtcggggtccgactcaggtacttgtctcaggtctcctgtaaccaccggcctggaggacccggggactcgggcaccacctcaccaagagagagtgaaggaccaagctggcctggctccgagttccaaagctacaggactaaggagttgggagcagggagcgtggtcctgcttgggagagggcaagttaagcttccaggggccatttctgggcaggccgacgcgctgggtttattaggaaacattcgctagaagaatgagttaagattgtaaaccaccaatgcagagaaaacgcctaactctgccggcctcgctcggccattaatgggtcttggggtgcgggtagagtcagcctctgacaacctcctcctgagacgacccagccttactggtactttttctcatgtatcacaggttacttctt

SEQ ID NO: 185076 - DNA, 2846 bp, Homo sapiens
  Payload ID: 16443
  Gene Symbol: SP1
  Gene Name: Sp1 transcription factor
  Uniprot ID: P08047
  ENST ID: ENST00000327443
  CDS Start-End: 99-2456
ggtccgggttcgcttgcctcgtcagcgtccgcgtttttcccggccccccccaacccccccggacaggacccccttgagcttgtccctcagctgccaccatgagcgaccaagatcactccatggatgaaatgacagctgtggtgaaaattgaaaaaggagttggtggcaataatgggggcaatggtaatggtggtggtgccttttcacaggctcgaagtagcagcacaggcagtagcagcagcactggaggaggagggcaggagtcccagccatcccctttggctctgctggcagcaacttgcagcagaattgagtcacccaatgagaacagcaacaactcccagggcccgagtcagtcagggggaacaggtgagcttgacctcacagccacacaactttcacagggtgccaatggctggcagatcatctcttcctcctctggggctacccctacctcaaaggaacagagtggcagcagtaccaatggcagcaatggcagtgagtcttccaagaatcgcacagtctctggtgggcagtatgttgtggctgccgctcccaacttacagaaccagcaagttctgacaggactacctggagtgatgcctaatattcagtatcaagtaatcccacagttccagaccgttgatgggcaacagctgcagtttgctgccactggggcccaagtgcagcaggatggttctggtcaaatacagatcataccaggtgcaaaccaacagattatcacaaatcgaggaagtggaggcaacatcattgctgctatgccaaacctactccagcaggctgtccccctccaaggcctggctaataatgtactctcaggacagactcagtatgtgaccaatgtaccagtggccctgaatgggaacatcaccttgctacctgtcaacagcgtttctgcagctaccttgactcccagctctcaggcagtcacgatcagcagctctgggtcccaggagagtggctcacagcctgtcacctcagggactaccatcagttctgccagcttggtatcatcacaagccagttccagctcctttttcaccaatgccaatagctactcaactactactaccaccagcaacatgggaattatgaactttactaccagtggatcatcagggaccaactctcaaggccagacaccccagagggtcagtgggctacaggggtctgatgctctgaacatccagcaaaaccagacatctggaggctcattgcaagcaggccagcaaaaagaaggagagcaaaaccagcagacacagcagcaacaaattcttatccagcctcagctagttcaagggggacaggccctccaggccctccaagcagcaccattgtcagggcagacctttacaactcaagccatctcccaggaaaccctccagaacctccagcttcaggctgttccaaactctggtcccatcatcatccggacaccaacagtggggcccaatggacaggtcagttggcagactctacagctgcagaacctccaagttcagaacccacaagcccaaacaatcaccttagccccaatgcagggtgtttccttggggcagaccagcagcagcaacaccactctcacacccattgcctcagctgcttccattcctgctggcacagtcactgtgaatgctgctcaactctcctccatgccaggcctccagaccattaacctcagtgcattgggtacttcaggaatccaggtgcacccaattcaaggcctgccgttggctatagcaaatgccccaggtgatcatggagctcagcttggtctccatggggctggtggtgatggaatacatgatgacacagcaggtggagaggaaggagaaaacagcccagatgcccaaccccaagccggtcggaggacccggcgggaagcatgcacctgcccctactgtaaagacagtgaaggaaggggctcgggggatcctggcaaaaagaaacagcatatttgccacatccaaggctgtgggaaagtgtatggcaagacctctcacctgcgggcacacttgcgctggcatacaggcgagaggccatttatgtgtacctggtcatactgtgggaaacgcttcacacgttcggatgagctacagaggcacaaacgtacacacacaggtgagaagaaatttgcctgccctgagtgtcctaagcgcttcatgaggagtgaccacctgtcaaaacatatcaagacccaccagaataagaagggaggcccaggtgtagctctgagtgtgggcactttgcccctggacagtggggcaggttcagaaggcagtggcactgccactccttcagcccttattaccaccaatatggtagccatggaggccatctgtccagagggcattgcccgtcttgccaacagtggcatcaacgtcatgcaggtggcagatctgcagtccattaatatcagtggcaatggcttctgagatcaggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatacttttt

SEQ ID NO: 185077 - DNA, 7603 bp, Homo sapiens
  Payload ID: 16443
  Gene Symbol: SP1
  Gene Name: Sp1 transcription factor
  Uniprot ID: P08047
  ENST ID: ENST00000426431
  CDS Start-End: 61-2397
agcgaaggccccgcccgggccaaccgcctgcctggtccgccctctgaccaagatcactccatggatgaaatgacagctgtggtgaaaattgaaaaaggagttggtggcaataatgggggcaatggtaatggtggtggtgccttttcacaggctcgaagtagcagcacaggcagtagcagcagcactggaggaggagggcaggagtcccagccatcccctttggctctgctggcagcaacttgcagcagaattgagtcacccaatgagaacagcaacaactcccagggcccgagtcagtcagggggaacaggtgagcttgacctcacagccacacaactttcacagggtgccaatggctggcagatcatctcttcctcctctggggctacccctacctcaaaggaacagagtggcagcagtaccaatggcagcaatggcagtgagtcttccaagaatcgcacagtctctggtgggcagtatgttgtggctgccgctcccaacttacagaaccagcaagttctgacaggactacctggagtgatgcctaatattcagtatcaagtaatcccacagttccagaccgttgatgggcaacagctgcagtttgctgccactggggcccaagtgcagcaggatggttctggtcaaatacagatcataccaggtgcaaaccaacagattatcacaaatcgaggaagtggaggcaacatcattgctgctatgccaaacctactccagcaggctgtccccctccaaggcctggctaataatgtactctcaggacagactcagtatgtgaccaatgtaccagtggccctgaatgggaacatcaccttgctacctgtcaacagcgtttctgcagctaccttgactcccagctctcaggcagtcacgatcagcagctctgggtcccaggagagtggctcacagcctgtcacctcagggactaccatcagttctgccagcttggtatcatcacaagccagttccagctcctttttcaccaatgccaatagctactcaactactactaccaccagcaacatgggaattatgaactttactaccagtggatcatcagggaccaactctcaaggccagacaccccagagggtcagtgggctacaggggtctgatgctctgaacatccagcaaaaccagacatctggaggctcattgcaagcaggccagcaaaaagaaggagagcaaaaccagcagacacagcagcaacaaattcttatccagcctcagctagttcaagggggacaggccctccaggccctccaagcagcaccattgtcagggcagacctttacaactcaagccatctcccaggaaaccctccagaacctccagcttcaggctgttccaaactctggtcccatcatcatccggacaccaacagtggggcccaatggacaggtcagttggcagactctacagctgcagaacctccaagttcagaacccacaagcccaaacaatcaccttagccccaatgcagggtgtttccttggggcagaccagcagcagcaacaccactctcacacccattgcctcagctgcttccattcctgctggcacagtcactgtgaatgctgctcaactctcctccatgccaggcctccagaccattaacctcagtgcattgggtacttcaggaatccaggtgcacccaattcaaggcctgccgttggctatagcaaatgccccaggtgatcatggagctcagcttggtctccatggggctggtggtgatggaatacatgatgacacagcaggtggagaggaaggagaaaacagcccagatgcccaaccccaagccggtcggaggacccggcgggaagcatgcacctgcccctactgtaaagacagtgaaggaaggggctcgggggatcctggcaaaaagaaacagcatatttgccacatccaaggctgtgggaaagtgtatggcaagacctctcacctgcgggcacacttgcgctggcatacaggcgagaggccatttatgtgtacctggtcatactgtgggaaacgcttcacacgttcggatgagctacagaggcacaaacgtacacacacaggtgagaagaaatttgcctgccctgagtgtcctaagcgcttcatgaggagtgaccacctgtcaaaacatatcaagacccaccagaataagaagggaggcccaggtgtagctctgagtgtgggcactttgcccctggacagtggggcaggttcagaaggcagtggcactgccactccttcagcccttattaccaccaatatggtagccatggaggccatctgtccagagggcattgcccgtcttgccaacagtggcatcaacgtcatgcaggtggcagatctgcagtccattaatatcagtggcaatggcttctgagatcaggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatactttttaacaaaaaacagattctatattattatatatatatatatatatataaagatatatagagatgcattcacaggggttggctgggaggaggaagaccattctgtgaccaaaataccttggtcattttttttatattgccttatttccctatggctgagccttgttgtgacacatcaagcttttctgtagatgttgtcttggcttcccaccagcttaagcgttcatatgctctgcttttagttcatatatacatacataatgtttttcctttcttaattttgtctttttgtttgggatcagcttcttgcactccttccctaactcaactgttgccgtctcatcttctctcatctgatcacttcatgttttgtttttgttactgcctggatgaggcacttctgtcaattttttcaggaccttagttccagcagcagaatggaaaaatccttgaagcccaggctgatgcttgaagtaactgtggagggagtgttcaaaatactactgacgcaggcaccttcttggcgctggagagtcaaaggcatctcccttcattagctgctctgagcatcaagaattagaagtctttcagtggaattgtacaagagtccctttgaagataataatcttggctcagtttgtataaactgtcaaattttcaaataataggtagggggctttcactaggaaaatcatgtgctcagaagaggaaatgactcgtagtcaggttcaggagttagtggagtatttggactttggtactgctgtcttccaaggtagctctaagttttgatgtgtgggcttctgagtttatattctgaaaggaaatacacttcttttgaacatccccactaggttcttttccattgtcaataaggagcatcagccagtgaatctgtttcaggtttccattctgcagaactcctccaaagcatgtgctagtggcaagacagtggttcttatgatgttttcccttaacttttccttgtatgttcttgggtggttcctaagggaaagggaagcacatgatcatgggaatgatagcccagaacaaaaagaaatcttgtcttaccacagtgttttataggagagattgggagaaatcatcctgttttctctgtgacctgatttcagaagagactgatccaaaaattataacggcagggaacctagtgcatttggcactgagatttaaatgcaaccagaattgtcctcaaggcccagccataaaagcattgtctctctcgaccttctggtatcttgttagagagcttttcactgtgaggaagtgtggaaaaatagctctgtgtgtgtgtgtgtgtgtgtgtgtgtgtgtgtgtgtaatctgttaggttggggataggttttctgctagccaatattaaaagagacctgcaataaaaaaattaccctgatctgatagaaagcaagtgtttttgtatgtgtgggtgaatgtgtgttcatgcccgtatatgtctacacacagatgacaaattatatttgaaatcgttggaaaataaattcagatcaaaatgcctttcaggcccattacctagaaatctatcttaaaacctgggtatgttcctaaggtcatttctttgcttatgctaaattaattacaattatgaatggaggatattctactgtacttttttaaaaagaaactatttttgtgtttgaaagtgaaaccaacatccagatctatagcagagtccttattcttctcataaatctttttactttggctacaaatagatgatggtatgattctattatatattttatataaaatccatccaaattaagttttgggtaagtgtgttgtttaatctgaactatagtaacttaatactctaaacaatagttcactccatttggtcctttctccacagatgtaattatgttttcaactcaggaactatggcaaggaactttccccagatcaaattctattaacgctgagatacaagtcatccatgcacagccactatcataccctttattctcactgaaaggcagaactcagaacctgttattttatgtctgtaatcatgtactttggcatcttttggaggaaaggggcaggataactcactggaatgtacagtattttgctagtgcatttcaaggaatggaatcttctccagtatgaaattaccagatataaaataatgtaatgatgctgaggatataagcttttagaaggtaatttgatggtatttctttctcgaatgaaaagctgctggtttaccctcaaccctattcattagcattaccatgagtgaatttatatctaattatttccacttgccctgttctcttcacaccaaggaagctccagatccagtatcttgtttggcctcaaaacagaagcagcttcttttgtctcccagcagtagtgagccactcagtctcttccacaggaagtttggagcctacattccttgagtcaggagcttattacagaaaaaccccgtttccctgaacttttggctaacagaaattaatttaactgacatgcatattgattctgaaatttttttcctaagtttttttcatttttttgaatgagttttttaaattttttagatgaccaaaacttgcagggcaggggatgcccagaagagtggtgagatagtaaaacacttattccctcatcctttcaggttttcaggttgcccatttatattcatttacatgtcatttgactgtctcactttttacccagaacagtaacaacccacaccgtcttccttcagggatttccaactggcactctgtgggtgctacacagaatgcaatttaatggatatttctcagcctggttcagaataaattgatcctttgatcccagaaagtatatactgaagtgtgggataaagattatgattaggggagggttggagacaaaagctgtaaattactatggctgatttatttctactatatacatatatattttttgcttttgtatatcctatataggaaactaagcattgtattttttttaacaaatctaaaaaagcactatgaactacaggtgtttgactttcaaaatatattttgtattgttaatatcttcacattgtgtgaatactggaagctgcagatctttgctaggacgcaataaatttatatactttttgaggggttcttctggggtgctaatcaggcccctgttatgcttagggggagccctggtgctacttgcttgaagttttcagtgtaagtaccctgatgccttttggaccttgggatcagatcaagagttttggagatcaggtaccaaggaaataaggacagtctagctgcctcaagtgaggggccctttgcatagctctccttccccctcactgaagctgggtagcctattggggttgagagggaaaatgtgaaatctcagaatttatctcccttagaagagagccagtaacttatgtacaaggatgaaagaaaggtcgcagcagtagctttggggaaagggaggaagatatggcacttctccaaccccggaaaacattgcttttgaaaactgctgataaaatatgagccggttattacttctgtttgggagactgtgctctctgtggtgcctctcttggctctactccacagataccagacctcttctaagaggatgagcagaccagctttgaggttgacctgtttctctttgtctgccttcccaaaacaccagcccccaggaagacattaagcagccttaagcttaaattcctactccctcttccaaatttggctcacttgccttagatccaaggcagggaaaggaaaagaaggggggtctctggctttattactcccctaagtctttactctgacttccccaaacccagaaagattttctccacagtgttcatttgaaagaggagtattttgtcccattttccccttcctcattatcaaacagccccagtcttccttgtctctgctaagaaagtagaggcatgatgatctgcctctcaactgccctaagtcctagctaagtatcaggggaaaaaaaaaaaaaaaaagcctaacaaatgggattagactagggctgcaagtagtgaggattttgttgatacctctgctgggatgtgtgctttcccatatcttgccttcaggaattacactgtgccttttccccagggatatgggctctgtctacccagtgctccagtttcccggtaactgctcttgaacattgtggacaagggcaggtcttcatatttttgatcatccctttctcccagtgaaatcccatagcccttacctagagtctagggcacaaagacttcggggaagatacactgagattgacctgaggagacatctacacacaccagtggcagctgccccagggcctgcttccccttcctaagtctgtcatcctctggaagggatgggtggtgctccaatctctggtgcctaaaaacccaagtttatttctctcttaacactggcaataaccagtccacaccactgttgccttttaaaacctcttaataatctcatgctgtgtttgttttgattccaatccaattatcaccagggctgtgtgggtaaatgcttttaaatgctctctcatcttgttcttccccctcaccccccactcttaggtatgtatgatgctaatcttgtccctaagtaagtttcttcctgctccttttgtatcttcctttcttgtctttcctcctaccttttgtctcttggtgttttgggacttttttttttttttttttggccttttgtacaaagattagtttcaatgtagtctgtagcctcctttgtaaaccaattaaaaagttttttaataaaaaa

SEQ ID NO: 185078 - DNA, 602 bp, Homo sapiens
  Payload ID: 16443
  Gene Symbol: SP1
  Gene Name: Sp1 transcription factor
  ENST ID: ENST00000551969
  CDS Start-End: 117-602
acccccccctccctgtccggtccgggttcgcttgcctcgtcagcgtccgcgtttttcccggccccccccaacccccccggacaggacccccttgagcttgtccctcagctgccaccatgagcgaccaagatcactccatggatgaaatgacagctgtggtgaaaattgaaaaaggagttggtggcaataatgggggcaatggtaatggtggtggtgccttttcacaggctcgaagtagcagcacaggcagtagcagcagcactggaggaggagggcagggtgccaatggctggcagatcatctcttcctcctctggggctacccctacctcaaaggaacagagtggcagcagtaccaatggcagcaatggcagtgagtcttccaagaatcgcacagtctctggtgggcagtatgttgtggctgccgctcccaacttacagaaccagcaagttctgacaggactacctggagtgatgcctaatattcagtatcaagtaatcccacagttccagaccgttgatgggcaacagctgcagtttgctgccactggggcccaagtgcagcaggatggttctggtcaaatacagatcataccaggtgca

SEQ ID NO: 185079 - DNA, 1061 bp, Homo sapiens
  Payload ID: 16443
  Gene Symbol: SP1
  Gene Name: Sp1 transcription factor
  ENST ID: ENST00000548560
  CDS Start-End: 372-1061
gttgttttatgccttacctgtccttttcctttttttcccttaggatactttttcttatttagaaactctcaccatgcctaccgtccttcacatttcctatccccaaagcactttttgaatgttttcttagtttaattttgtacaagggagaattaaggcccacttttggcacattgaacctagttcatgtcctgcatgccctgcagctcccctctgccctccaatccattttctttatactggtggctttcgccttcctgttagtcattgctatttcatcatagcctccttttatccttcctacttcatttcttttcttccctcaagtttacgttgtttgttttttaattattttagaccaagatcactccatggatgaaatgacagctgtggtgaaaattgaaaaaggagttggtggcaataatgggggcaatggtaatggtggtggtgccttttcacaggctcgaagtagcagcacaggcagtagcagcagcactggaggaggagggcaggagtcccagccatcccctttggctctgctggcagcaacttgcagcagaattgagtcacccaatgagaacagcaacaactcccagggcccgagtcagtcagggggaacaggtgagcttgacctcacagccacacaactttcacagggtgccaatggctggcagatcatctcttcctcctctggggctacccctacctcaaaggaacagagtggcagcagtaccaatggcagcaatggcagtgagtcttccaagaatcgcacagtctctggtgggcagtatgttgtggctgccgctcccaacttacagaaccagcaagttctgacaggactacctggagtgatgcctaatattcagtatcaagtaatcccacagttccagaccgttgatgggcaacagctgcagtttgctgccactggggcccaagtgcagcaggatggttctggtcaaatacagatcataccaggtgcaaaccaacagattatcacaaatcgaggaagtggaggcaacatcattgctgctatgccaaacctactccagcaggctgtcccc

SEQ ID NO: 185080 - DNA, 3882 bp, Homo sapiens
  Payload ID: 16444
  Gene Symbol: SP100
  Gene Name: SP100 nuclear antigen
  Uniprot ID: P23497
  ENST ID: ENST00000264052
  CDS Start-End: 356-2995
gtattgcacaaacaagtggacacccgggagctggccctgctcgtcccctgggccctccttccctggtcctgcaggtcttgctgcttgtcaggcctctcctccaaccctctgccacatttcagaaaagctgagaatcccttggagtgaaaaaggaggagaaacacagtgtccgtagcccagaaggaggttaaatactttcacttctcttttccccatttgggcggagccctttctgagtcagtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcgagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggatcacagccacaagaacctgaaaataagaagtgctcctgtgtcatgtgttttccaaaaggtgtgccaagaagccaagaagcaaggactgaaagtagtcaagcatctgacatgatggataccatggatgttgaaaacaattctactttggaaaaacacagtgggaaaagaagaaaaaagagaaggcatagatctaaagtaaatggtctccaaagagggagaaagaaagacagacctagaaaacatttaactctgaataacaaagtccaaaagaaaagatggcaacaaagaggaagaaaagccaacactagacctttgaaaagaagaagaaaaagaggtccaagaattcccaaagatgaaaatattaattttaaacaatctgaacttcctgtgacctgtggtgaggtgaagggcactctatataaggagcgattcaaacaaggaacctcaaagaagtgtatacagagtgaggataaaaagtggttcactcccagggaatttgaaattgaaggagaccgcggagcatccaagaactggaagctaagtatacgctgcggtggatataccctgaaagtcctgatggagaacaaatttctgccagaaccaccaagcacaagaaaaaagagaatactggaatctcacaacaataccttagttgacccttgtgaggagcataagaagaagaacccagatgcttcagtcaagttctcagagtttttaaagaagtgctcagagacatggaagaccatttttgctaaagagaaaggaaaatttgaagatatggcaaaggcggacaaggcccattatgaaagagaaatgaaaacctatatccctcctaaaggggagaaaaaaaagaagttcaaggatcccaatgcacccaagaggcctcctttggcctttttcctgttctgctctgagtatcgcccaaaaatcaaaggagaacatcctggcctgtccattgatgatgttgtgaagaaactggcagggatgtggaataacaccgctgcagctgacaagcagttttatgaaaagaaggctgcaaagctgaaggaaaaatacaaaaaggatattgctgcatatcgagctaaaggaaagcctaattcagcaaaaaagagagttgtcaaggctgaaaaaagcaagaaaaagaaggaagaggaagaagatgaagaggatgaacaagaggaggaaaatgaagaagatgatgataaataagttgcttctagtgcagtttttttcttgtctataaagcatttaagctgcctgtacacaactcactccttttaaagaaaaaaacttcaacgtaagactgtgtaagatttgtttttaaaccgtacactgtgtttttttgtatagttaaccactaccgaatgtgtcttcagatagccctgtcctggtggtatttagccactaacctttgcctggtacagtatgggggttgtaaattggcatggaaatttaaagcaggttcttgttagtgcacagcacaaattagttgtatatgaggatggtagttttttcaccttcagttgtctctgatgtagcttatacaaaacatttgttgttctgttaactgaatgccactctgtaattgcaaaaaaaaaaaacagttgcagctgttttgttgacattctgaatgcttctaagtaaatacaatttttaaaaaaccgtatgagggaactgtgtagacaaggtaccaggtcagtcttcttccatgtctattagctccacaaagccaatctcaatccctcaaaacaatcttgtcatacttgaaaatatgacactctagtcaaagccttggtaaaataatcagtgtttccaatctgtcctgttacaaaagaaacagattattattgaacttatgcaaataaccattgtcataagaatgtttatgaatagtttccaaattatggcaaattcatgtagagagagaaaagtaactgttttggttttgctcacaaaagtctactttacctaagggctgtcagatataagtaacttaaaagaaagagaagttttcttgacttttgaaaacaaaatatgaaaagaatcggcaatgtttcaaacaaaaagtcataaaagtcactttattcctccatcaa

SEQ ID NO: 185081 - DNA, 2926 bp, Homo sapiens
  Payload ID: 16444
  Gene Symbol: SP100
  Gene Name: SP100 nuclear antigen
  Uniprot ID: P23497
  ENST ID: ENST00000340126
  CDS Start-End: 32-2689
ctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcgagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggatcacagccacaagaacctgaaaataagaagtgctcctgtgtcatgtgttttccaaaaggtgtgccaagaagccaagaagcaaggactgaaagtagtcaagcatctgacatgatggataccatggatgttgaaaacaattctactttggaaaaacacagtgggaaaagaagaaaaaagagaaggcatagatctaaagtaaatggtctccaaagagggagaaagaaagacagacctagaaaacatttaactctgaataacaaagtccaaaagaaaagatggcaacaaagaggaagaaaagccaacactagacctttgaaaagaagaagaaaaagaggtccaagaattcccaaagatgaaaatattaattttaaacaatctgaacttcctgtgacctgtggtgaggtgaagggcactctatataaggagcgattcaaacaaggaacctcaaagaagtgtatacagagtgaggataaaaagtggttcactcccagggaatttgaaattgaaggagaccgcggagcatccaagaactggaagctaagtatacgctgcggtggatataccctgaaagtcctgatggagaacaaatttctgccagaaccaccaagcacaagaaaaaagagaatactggaatctcacaacaataccttagttgacccttgtccggaaaactcaaatatatgtgaggtgtgcaacaaatggggacggctgttctgctgcgacacttgtccaagatcctttcatgagcactgccacatcccatccgtggaagctaacaagaacccgtggagttgcatcttctgcaggataaagactattcaggaaagatgcccagaaagccaatcaggtcatcaggaatctgaagtcctgatgaggcagatgctgcctgaggagcagttgaaatgtgaattcctcctcttgaaggtctactgtgattcgaaaagctgctttttcgcctcagaaccgtattataacagagaggggtctcagggcccacagaagcccatgtggttaaacaaagtcaagacaagtttgaatgagcagatgtacacccgagtagaagggtttgtgcaggacatgcgtctcatctttcataaccacaaggaattttacagggaagataaattcaccagactgggaattcaagtacaggacatctttgagaagaatttcagaaacatttttgcaattcaggaaacaagcaagaacattataatgtttatttagccattcttatctcctcccttcagatcctctggcagctagctacgcaatgtgcctgtggtcccactaatctgtgactgctcctgtggaaactccacatcacaattctccaaaatttatcattgccattttaaaaccgtcttttcagctttcaataaaattcaacaccccttcatgttaaaaattctcaataagctaggtattgaggaacatatcccaaaataataagagccatttatg

SEQ ID NO: 185082 - DNA, 1898 bp, Homo sapiens
  Payload ID: 16444
  Gene Symbol: SP100
  Gene Name: SP100 nuclear antigen
  Uniprot ID: P23497
  ENST ID: ENST00000409341
  CDS Start-End: 51-1493
ggggctcagaggccaggctctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcgagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcatttgtaattgtaaagcctcaaaagacaactgttcctactatgtaattatagacagaaataaaaacttcagatc

SEQ ID NO: 185083 - DNA, 2198 bp, Homo sapiens
  Payload ID: 16444
  Gene Symbol: SP100
  Gene Name: SP100 nuclear antigen
  Uniprot ID: P23497
  ENST ID: ENST00000409112
  CDS Start-End: 32-2098
ctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcgagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggatcacagccacaagaacctgaaaataagaagtgctcctgtgtcatgtgttttccaaaaggtgtgccaagaagccaagaagcaaggactgaaagtagtcaagcatctgacatgatggataccatggatgttgaaaacaattctactttggaaaaacacagtgggaaaagaagaaaaaagagaaggcatagatctaaagtaaatggtctccaaagagggagaaagaaagacagacctagaaaacatttaactctgaataacaaagtccaaaagaaaagatggcaacaaagaggaagaaaagccaacactagacctttgaaaagaagaagaaaaagaggtccaagaattcccaaagatgaaaatattaattttaaacaatctgaacttcctgtgacctgtggtgaggtgaagggcactctatataaggagcgattcaaacaaggaacctcaaagaagtgtatacagagtgaggataaaaagtggttcactcccagggaatttgaaattgaaggagaccgcggagcatccaagaactggaagctaagtatacgctgcggtggatataccctgaaagtcctgatggagaacaaatttctgccagaaccaccaagcacaagaaaaaaggtgatgatcaagtgatcttctgccaatgtctcgtctattatgttgttgattttctatctctgtggacttacagtctttaaattgacccatcatcataaaatttgattttataata

SEQ ID NO: 185084 - DNA, 2037 bp, Homo sapiens
  Payload ID: 16444
  Gene Symbol: SP100
  Gene Name: SP100 nuclear antigen
  Uniprot ID: P23497
  ENST ID: ENST00000409897
  CDS Start-End: 282-1619
agacgctgtggtctcacctgtcctggcaaggggcctctgccggctgttcccatgactggctcagggtctgagttcttattccatcaaccttgatcaaaagaaggaaagggaagaaaaaggcccagggaggctgaatgaatgtatttcaccagtagcaaatgagatgaaccatcttcctgcacacagccacgatttgcaaaggtttttggagaggaataaatttaatgaaagatgtacatgacttctaaaaactataagcagtgctgggtaaaattaaacacatgatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcgagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcatttgtaattgtaaagcctcaaaagacaactgttcctactatgtaattatagacagaaataaaaacttcagatcaaacactctcaaa

SEQ ID NO: 185085 - DNA, 1802 bp, Homo sapiens
  Payload ID: 16444
  Gene Symbol: SP100
  Gene Name: SP100 nuclear antigen
  ENST ID: ENST00000409824
  CDS Start-End: 58-1425
cgactgaggggctcagaggccaggctctgaggcccacgcagggcctagggtgggaagatggcaggtgggggcggcgacctgagcaccaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcgagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcatttgtaattgtaaagcctcaaaagacaactgttcctactatgtaa

SEQ ID NO: 185086 - DNA, 654 bp, Homo sapiens
  Payload ID: 16444
  Gene Symbol: SP100
  Gene Name: SP100 nuclear antigen
  ENST ID: ENST00000432979
  CDS Start-End: 77-654
cactgcacgcaggctgggccgactgaggggctcagaggccaggctctgaggcccacgcagggcctagggtgggaagatggcaggtgggggcggcgacctgagcaccaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggttgcctaggagggtttcttcctcccacaccccttaatcacacttgctgctggttcctgctgccgct

SEQ ID NO: 185087 - DNA, 1922 bp, Homo sapiens
  Payload ID: 16444
  Gene Symbol: SP100
  Gene Name: SP100 nuclear antigen
  ENST ID: ENST00000431952
  CDS Start-End: 1-778
cactctatataaggagcgattcaaacaaggaacctcaaagaagtgtatacagagtgaggataaaaagtggttcactcccagggaatttgaaattgaaggagaccgcggagcatccaagaactggaagctaagtatacgctgcggtggatataccctgaaagtcctgatggagagaatactggaatctcacaacaataccttagttgacccttgtccggaaaactcaaatatatgtgaggtgtgcaacaaatggggacggctgttctgctgcgacacttgtccaagatcctttcatgagcactgccacatcccatccgtggaagctaacaagaacccgtggagttgcatcttctgcaggataaagactattcaggaaagatgcccagaaagccaatcaggtcatcaggaatctgaagtcctgatgaggcagatgctgcctgaggagcagttgaaatgtgaattcctcctcttgaaggtctactgtgattcgaaaagctgctttttcgcctcagaaccgtattataacagagaggggtctcagggcccacagaagcccatgtggttaaacaaagtcaagacaagtttgaatgagcagatgtacacccgagtagaagggtttgtgcaggacatgcgtctcatctttcataaccacaaggaattttacagggaagataaattcaccagactgggaattcaagtacaggacatctttgagaagaatttcagaaacatttttgcaattcaggaaacaagcaagaacattataatgtttatttagccattcttatctcctcccttcagatcctctggcagctagctacgcaatgtgcctgtggtcccactaatctgtgactgctcctgtggaaactccacatcacaattctccaaaatttatcattgccattttaaaaccgtcttttcagctttcaataaaattcaacaccccttcatgttaaaaattctcaataagctaggtattgaggaacatatcccaaaataataagagccatttatgacaaacccacagacaacattatatggaatgcgcaaaagaagcattccccttgaaaacaagcacaagacaaggattccctctctcaccactcctattcaacaaagtattggaagtcctggtcagagcagtcaggaagcagaaaaaaataaagggtatctaaataggcaaagaggaagtcaaactatccctgtttgcacacaacattgattctatatctagaaaaccccctagtctcagcccagaagctccttctgctgataaacaatttcagagatgtttcagaatacaaaattagtatatgaaaattactagtattcctatacaccagcaatagccaagccaagagccaaatcaggaaggcaatctcattcacaattgccactaaaagaataaaatacctaggaatacagctaatcagggaggtgagagagttctacaatgagaattacgaaacactgctcaaagagattggagatgacacaaacaaatggaaaaacatcccatgctcctgtgtagaaacagtcaatatcattaaaatgaccatactgcccaaagcagtttacaggttcaatgttattcctatcaaaccaccaatgacattcttcacagaactagataaaactattttaaaattcatacagaaccaaaaaagagcccaaatagccaaggcaatcctaagcaaaaagaacaaagctgaaggcatcacgttaccccacttcaaactatattacagggcttcagtaaccaaaacagcatggtactggtaccaaaaaaaaagccacatagaccaatggaacagaacgaagagcacagaataagaccacactcctatgaccatctgatcgtcgataaaaacaagcaatgggaaaaagactccctattttataaatggtgctgggataactgg

SEQ ID NO: 185088 - DNA, 1922 bp, Homo sapiens
  Payload ID: 16444
  Gene Symbol: SP100
  Gene Name: SP100 nuclear antigen
  Uniprot ID: P23497
  ENST ID: ENST00000427101
  CDS Start-End: 142-1500
atttgggcggagccctttctgagtcagtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcgagcggggcactgagaagcaagcatgctcctatgacttctagaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggaaagaggcaggaaattatgataaactcatgtttaacagaaagagtttcactgactaaatgtatgtaattatattttgttgttgtagaagaaataaatagcaaatttgtggtattcttttttttaaacctgctctcattcctattaacactaagatcttagatttttatagtgataaatgggttgacatcattgtcatttgtaattgtaaagcctcaaaagacaactgttcctactatgtaattatagacagaaataaaaacttcagatcaaacactctcaaacgtt

SEQ ID NO: 185089 - DNA, 377 bp, Homo sapiens
  Payload ID: 16444
  Gene Symbol: SP100
  Gene Name: SP100 nuclear antigen
  ENST ID: ENST00000413284
  CDS Start-End: 1-377
tcatcagcagtgaggactctgaaggatccactgacgttgatgagcccttagaagtcttcatctcagcaccgagaagtgagcctgagcccatggatttcagaaaattatctacattcagagaaagttttaagaaaagagtgataggacaagaccacgacttttcagaatccagtgaggaggaggcgcccgcagaagcctcgagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtaaa

SEQ ID NO: 185090 - DNA, 580 bp, Homo sapiens
  Payload ID: 16444
  Gene Symbol: SP100
  Gene Name: SP100 nuclear antigen
  ENST ID: ENST00000452345
  CDS Start-End: 1-580
gacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcgagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggtgtgccaagaagccaagaagcaaggactgaaagtagtcaagcatctgacatgatggataccatggatgttgaaaacaattctactttggaaaaacacagtgggaaaagaagaaaaaagagaaggcatagatctaaagtaaatggtctccaaagag

SEQ ID NO: 185091 - DNA, 2426 bp, Homo sapiens
  Payload ID: 16445
  Gene Symbol: SP110
  Gene Name: SP110 nuclear body protein
  Uniprot ID: Q9HB58
  ENST ID: ENST00000258381
  CDS Start-End: 79-2220
gtaactctcccaatcttgaggagtgatccctgtcccagcccctggaaaggggcaggaacgacaaactcaaagtccaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaggagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagattgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagcggaaaaactcggatgaatgcgaggtgtgctgtcaagggggacaacttctctgctgcggtacttgtccacgagtcttccatgaggactgtcacatcccccctgtggaagccaagaggatgctgtggagttgcaccttctgcaggatgaagaggtcttcaggaagccaacagtgccatcatgtatctaagaccctggagaggcagatgcagcctcaggaccagctgaaatgtgagttcctcctcttgaaggcctactgtcatccacaaagctccttttttacgggcatcccatttaatattcgagattacggtgagccctttcaggaagcaatgtggttggacctggttaaggaaaggctgattacggaaatgtacacggtggcatggtttgtgcgagacatgcgcctgatgtttcgcaaccataaaacattttacaaggcttctgactttggccaggtaggacttgacttagaggcagaatttgaaaaagatctcaaagacgtgctcggttttcatgaagccaatgacggcggtttctggactcttccttgaccctgttctgtaaagactgaagcatccccacctcaggattcagctgatgggaccctggcttggactgttgattgccagtgagtctgggatgtaattggctgccctcaggacccaaacccagacacttcataggattatcacaccctccatctttattctttctttttacctttaaaagtctatatctacactaaaaaaaaaaaaaa

SEQ ID NO: 185092 - DNA, 2080 bp, Homo sapiens
  Payload ID: 16445
  Gene Symbol: SP110
  Gene Name: SP110 nuclear body protein
  Uniprot ID: Q9HB58
  ENST ID: ENST00000258382
  CDS Start-End: 241-1890
aagtgcccatgaggaggtggagagaggctgcaggcaccgacctgccttcagcttccggcttggcaaactccgaaaactttcacttttcttttctcggaagcccggccccttactgcgtttgtcaaagcacagacttcctgttttgcctgctagcatctccctgtaactctcccaatcttgaggagtgatccctgtcccagcccctggaaaggggcaggaacgacaaactcaaagtccaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaggagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagattgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagagtggacttttgctctgtcctccaagaataaatctcaagagagagttaaatagcaagtgaatttctactaccctctcagtcaccatgttgcagactttccctgtctggaggctcaccttagagcttctgagtttccaagctctgagtcacctccacatttgggcatggcatcttcaaaacaattaatttgcatagttaatttgggatggggaagcaaatgactctaaaataaaaattaaatgaaaaagct

SEQ ID NO: 185093 - DNA, 2337 bp, Homo sapiens
  Payload ID: 16445
  Gene Symbol: SP110
  Gene Name: SP110 nuclear body protein
  Uniprot ID: Q9HB58
  ENST ID: ENST00000358662
  CDS Start-End: 80-2149
tgtaactctcccaatcttgaggagtgatccctgtcccagcccctggaaaggggcaggaacgacaaactcaaagtccaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaggagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagattgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagcggaaaaactcggatgaatgcgaggtgtgctgtcaagggggacaacttctctgctgcggtacttgtccacgagtcttccatgaggactgtcacatcccccctgtggaagccaagaggatgctgtggagttgcaccttctgcaggatgaagaggtcttcaggaagccaacagtgccatcatgtatctaagaccctggagaggcagatgcagcctcaggaccagctgattcgagattacggtgagccctttcaggaagcaatgtggttggacctggttaaggaaaggctgattacggaaatgtacacggtggcatggtttgtgcgagacatgcgcctgatgtttcgcaaccataaaacattttacaaggcttctgactttggccaggtaggacttgacttagaggcagaatttgaaaaagatctcaaagacgtgctcggttttcatgaagccaatgacggcggtttctggactcttccttgaccctgttctgtaaagactgaagcatccccacctcaggattcagctgatgggaccctggcttggactgttgattgccagtgagtctgggatgtaattggctgccctcaggacccaaacccagacacttcataggattatcacaccctccatctttattctttctttttacctttaaaagtctatatcta

SEQ ID NO: 185094 - DNA, 1937 bp, Homo sapiens
  Payload ID: 16445
  Gene Symbol: SP110
  Gene Name: SP110 nuclear body protein
  ENST ID: ENST00000392048
  CDS Start-End: 102-1745
gttttgcctgctagcatctccctgtaactctcccaatcttgaggagtgatccctgtcccagcccctggaaaggggcaggaacgacaaactcaaagtccaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaggagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagattgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagagtggacttttgctctgtcctccaagaataaatctcaagagagagttaaatagcaagtgaatttctactaccctctcagtcaccatgttgcagactttccctgtctggaggctcaccttagagcttctgagtttccaagctctgagtcacctccacatttgggcatggcatcttcaaaacaattaatttgcatagttaatttgggatggggaagcaaatgactctaaaataaaaattaaatgaaaaagctca

SEQ ID NO: 185095 - DNA, 813 bp, Homo sapiens
  Payload ID: 16445
  Gene Symbol: SP110
  Gene Name: SP110 nuclear body protein
  ENST ID: ENST00000409815
  CDS Start-End: 149-813
ggggcaggaacgacaaactcaaagtccagagtccagcctgttattgtgaatggagccgagatttgccctctaccctcacctaagctctgatccttcagtgcccgcaataggcggctcatctgttatccattgtgtaaatgactagaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgca

SEQ ID NO: 185096 - DNA, 600 bp, Homo sapiens
  Payload ID: 16445
  Gene Symbol: SP110
  Gene Name: SP110 nuclear body protein
  ENST ID: ENST00000455674
  CDS Start-End: 121-600
agcatctccctgtaactctcccaatcttgaggagtgatccctgtcccagcccctggaaaggggcaggaacgacaaactcaaagtccaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcg

SEQ ID NO: 185097 - DNA, 580 bp, Homo sapiens
  Payload ID: 16445
  Gene Symbol: SP110
  Gene Name: SP110 nuclear body protein
  ENST ID: ENST00000416610
  CDS Start-End: 277-580
gaaattgcctaactagctgacgtgggtgcaccaactctacagtcctccctccacccaatctccatgacgtctctcagtcaagggaggaggagcagagccagccccacgaggccacggaagacagggtcacttgttcctgccaaggaaagagggtggaaaagtcattcaactcaagcagatcaaagttgttttgagatctaaaggaagaagttcttgctgccaggatcctcagatgcccatgaaggggctttccaggtgatggggaggggcttcaggatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaa

SEQ ID NO: 185098 - DNA, 2910 bp, Homo sapiens
  Payload ID: 16446
  Gene Symbol: SP140
  Gene Name: SP140 nuclear body protein
  Uniprot ID: Q13342
  ENST ID: ENST00000343805
  CDS Start-End: 101-2524
tttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaacattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatgtatgctatgaacactcacctctccaaatgaataatgtaaacgatttagaagatagacccagattactaccatatggtaaacaagagaacagcaatgcctgtcatgaaatggatgatatagcagtgcctcaggaagccttgagctcctcgccaaggtgtgagccaggtttctcttcagagtcttgtgagcagttagctctcccaaaggctggtggaggagatgctgaagatgcacccagcctactaccaggtgggggagttctagaaagcaacgggatgatagatgcggcaaggacatacagcacagcaccaggggagaaacagggagaggaggaaggcaggaacagtcccagaaaaagaaaccaagacaaggagaagtaccaagagagtccagagggaagagacaaagagacctttgatctaaaaactccccaagtcactaatgaaggagaaccagagaaggggctctgtctactaccaggtgaaggagaagagggcagtgatgactgttcagaaatgtgtgatggagaagagccccaggaagcctctagctccctagcaagatgtgggtcagagggcagtgatgactgttcggaaatgtgtgatggagaagagcgccaggaagcctctagctccctagcaagacgtgggtcagtgtctagtgaactagaaaatcacccaatgaatgaagaaggagaatcagaagagcttgcttctagcctgctatatgataatgtaccaggagcggagcaatcagcatatgaaaatgagaagtgttcctgtgtcatgtgtttctcagaagaggtgccaggaagcccagaagcaaggacggaaagtgatcaagcgtgtggcacaatggatactgtggatattgcaaacaactccactttgggaaaacccaagaggaaaagaagaaaaaagagggggcatggctggagcagaatgagaatgagaaggcaggaaaacagccaacaaaatgataatagcaaagccgacggccaggtggtctccagtgaaaagaaggcgaacgtgaatctgaaagacctttccaagattagggggagaaagagaggcaaacctggaacccgcttcactcagagtgacagagctgcacagaaaagagtccgatcaagagcttcaagaaagcacaaagatgaaactgtggattttaaggctcctttgcttccagtgacctgtggtggggtgaagggaattttacataagaagaaattgcagcaaggaatcttggtgaagtgtatacagactgaggatggaaaatggttcacccccacggaatttgaaatcaaaggaggccatgcaagatcaaagaactggaggctgagtgtgcgctgtggcgggtggcccctacgatggctgatggagaatggatttctgcctgatcctccaagaatacgttacaggaaaaaaaagagaatactgaagtctcaaaacaatagctcagttgacccttgtatgagaaacctggatgagtgtgaggtgtgccgggacggaggggagctgttctgttgcgacacttgttcaagagtcttccatgaggactgtcacatcccgcctgtggaagctgagaggaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtacaaggattttggccaaatgggatttagactggaggctgagtttgagaagaatttcaaggaagtgtttgctattcaggaaacaaatgggaacaattgactggattagtggatgctgaaagcattcagcaaatggcaccctaaaatatgccgctggtttgccactgacttcaaaatgaggtcacttgggcacagcacatgcagggaggggcttttctctgagcctccttcatctgcccaaagacaaatcctcaaaaggaaattcaatcatcatgaatcacaaccccaagtatctcatcagccagggaagagtaagtgggatcacagggaaggatgttggcagcgacaccatcccatacaggctcttacctcttctcctgagggctgctccagacaacatttattacccagaagaccttttgtctgaaaaccagccaagctttattcaggacacacttcttgccttcactttcccacttccgtggc

SEQ ID NO: 185099 - DNA, 814 bp, Homo sapiens
  Payload ID: 16446
  Gene Symbol: SP140
  Gene Name: SP140 nuclear body protein
  Uniprot ID: Q13342
  ENST ID: ENST00000373645
  CDS Start-End: 82-600
gcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaacattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatgaaaatttatcatccagtgcagtcctgtgtcaacttgtttctccaaacaaagactggagaagtcacgaagagagcctagcacatactggtacactgaggaggagctgcatgtgaaagctatgaagacagaaaagggggttggtgggggcctttccgaaccatgtggttgaattgcagactgtgggaggcagggtgtgagagctgactctggagaaagaagttgaagtggattctggaaggcttgacaccctgtgctaaggaatctggagtttaatttttggaaaataaagaaggaataaagggcatttaaacgggaaaagtaaaagaa

SEQ ID NO: 185100 - DNA, 3246 bp, Homo sapiens
  Payload ID: 16446
  Gene Symbol: SP140
  Gene Name: SP140 nuclear body protein
  Uniprot ID: Q13342
  ENST ID: ENST00000392045
  CDS Start-End: 115-2718
cttttcttttcctctttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaacattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatgtatgctatgaacactcacctctccaaatgaataatgtaaacgatttagaagatagacccagattactaccatatggtaaacaagagaacagcaatgcctgtcatgaaatggatgatatagcagtgcctcaggaagccttgagctcctcgccaaggtgtgagccaggtttctcttcagagtcttgtgagcagttagctctcccaaaggctggtggaggagatgctgaagatgcacccagcctactaccaggtgggggagtgtcctgtaaacttgctatacaaatagatgaaggagaatcagaagaaatgcccaagttactgccttatgatacagaagttctagaaagcaacgggatgatagatgcggcaaggacatacagcacagcaccaggggagaaacagggagaggaggaaggcaggaacagtcccagaaaaagaaaccaagacaaggagaagtaccaagagagtccagagggaagagacaaagagacctttgatctaaaaactccccaagtcactaatgaaggagaaccagagaaggggctctgtctactaccaggtgaaggagaagagggcagtgatgactgttcagaaatgtgtgatggagaagagccccaggaagcctctagctccctagcaagatgtgggtcagtttcttgtttatctgcagagacctttgatctaaagactccccaagtcactaatgaaggagaaccagagaaggagctcagtctactaccaggtgaaggagaagagggcagtgatgactgttcggaaatgtgtgatggagaagagcgccaggaagcctctagctccctagcaagacgtgggtcagtgtctagtgaactagaaaatcacccaatgaatgaagaaggagaatcagaagagcttgcttctagcctgctatatgataatgtaccaggagcggagcaatcagcatatgaaaatgagaagtgttcctgtgtcatgtgtttctcagaagaggtgccaggaagcccagaagcaaggacggaaagtgatcaagcgtgtggcacaatggatactgtggatattgcaaacaactccactttgggaaaacccaagaggaaaagaagaaaaaagagggggcatggctggagcagaatgagaatgagaaggcaggaaaacagccaacaaaatgataatagcaaagccgacggccaggtggtctccagtgaaaagaaggcgaacgtgaatctgaaagacctttccaagattagggggagaaagagaggcaaacctggaacccgcttcactcagagtgacagagctgcacagaaaagagtccgatcaagagcttcaagaaagcacaaagatgaaactgtggattttaaggctcctttgcttccagtgacctgtggtggggtgaagggaattttacataagaagaaattgcagcaaggaatcttggtgaagtgtatacagactgaggatggaaaatggttcacccccacggaatttgaaatcaaaggaggccatgcaagatcaaagaactggaggctgagtgtgcgctgtggcgggtggcccctacgatggctgatggagaatggatttctgcctgatcctccaagaatacgttacaggaaaaaaaagagaatactgaagtctcaaaacaatagctcagttgacccttgtatgagaaacctggatgagtgtgaggtgtgccgggacggaggggagctgttctgttgcgacacttgttcaagagtcttccatgaggactgtcacatcccgcctgtggaagctgagaggaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtacaaggattttggccaaatgggatttagactggaggctgagtttgagaagaatttcaaggaagtgtttgctattcaggaaacaaatgggaacaattgactggattagtggatgctgaaagcattcagcaaatggcaccctaaaatatgccgctggtttgccactgacttcaaaatgaggtcacttgggcacagcacatgcagggaggggcttttctctgagcctccttcatctgcccaaagacaaatcctcaaaaggaaattcaatcatcatgaatcacaaccccaagtatctcatcagccagggaagagtaagtgggatcacagggaaggatgttggcagcgacaccatcccatacaggctcttacctcttctcctgagggctgctccagacaacatttattacccagaagaccttttgtctgaaaaccagccaagctttattcaggacacacttcttgccttcactttcccacttccgtggccacctccatgcagaagccctaagcccacattctttcgatagctcacggtggtgcatgagtgtccatcatctgactcttctcggagtctcatattttgtgggactcctgtgcaaacatatgttattaaaatttttttcctcct

SEQ ID NO: 185101 - DNA, 2895 bp, Homo sapiens
  Payload ID: 16446
  Gene Symbol: SP140
  Gene Name: SP140 nuclear body protein
  Uniprot ID: Q13342
  ENST ID: ENST00000417495
  CDS Start-End: 104-2365
ctctttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaacattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatgtatgctatgaacactcacctctccaaatgaataatgtaaacgatttagaagatagacccagattactaccatatggtaaacaagagaacagcaatgcctgtcatgaaatggatgatatagcagtgcctcaggaagccttgagctcctcgccaaggtgtgagccaggtttctcttcagagtcttgtgagcagttagctctcccaaaggctggtggaggagatgctgaagatgcacccagcctactaccagtgtcctgtaaacttgctatacaaatagatgaaggagaatcagaagaaatgcccaagttactgccttatgatacagaagagacctttgatctaaaaactccccaagtcactaatgaaggagaaccagagaaggggctctgtctactaccaggtgaaggagaagagggcagtgatgactgttcggaaatgtgtgatggagaagagcgccaggaagcctctagctccctagcaagacgtgggtcagtgtctagtgaactagaaaatcacccaatgaatgaagaaggagaatcagaagagcttgcttctagcctgctatatgataatgtaccaggagcggagcaatcagcatatgaaaatgagaagtgttcctgtgtcatgtgtttctcagaagaggtgccaggaagcccagaagcaaggacggaaagtgatcaagcgtgtggcacaatggatactgtggatattgcaaacaactccactttgggaaaacccaagaggaaaagaagaaaaaagagggggcatggctggagcagaatgagaatgagaaggcaggaaaacagccaacaaaatgataatagcaaagccgacggccaggtggtctccagtgaaaagaaggcgaacgtgaatctgaaagacctttccaagattagggggagaaagagaggcaaacctggaacccgcttcactcagagtgacagagctgcacagaaaagagtccgatcaagagcttcaagaaagcacaaagatgaaactgtggattttaaggctcctttgcttccagtgacctgtggtggggtgaagggaattttacataagaagaaattgcagcaaggaatcttggtgaagtgtatacagactgaggatggaaaatggttcacccccacggaatttgaaatcaaaggaggccatgcaagatcaaagaactggaggctgagtgtgcgctgtggcgggtggcccctacgatggctgatggagaatggatttctgcctgatcctccaagaatacgttacaggaaaaaaaagagaatactgaagtctcaaaacaatagctcagttgacccttgtatgagaaacctggatgagtgtgaggtgtgccgggacggaggggagctgttctgttgcgacacttgttcaagagtcttccatgaggactgtcacatcccgcctgtggaagctgagaggaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtacaaggattttggccaaatgggatttagactggaggctgagtttgagaagaatttcaaggaagtgtttgctattcaggaaacaaatgggaacaattgactggattagtggatgctgaaagcattcagcaaatggcaccctaaaatatgccgctggtttgccactgacttcaaaatgaggtcacttgggcacagcacatgcagggaggggcttttctctgagcctccttcatctgcccaaagacaaatcctcaaaaggaaattcaatcatcatgaatcacaaccccaagtatctcatcagccagggaagagtaagtgggatcacagggaaggatgttggcagcgacaccatcccatacaggctcttacctcttctcctgagggctgctccagacaacatttattacccagaagaccttttgtctgaaaaccagccaagctttattcaggacacacttcttgccttcactttcccacttccgtggccacctccatgcagaagccctaagcccacattctttcgatagctcacggtggtgcatgagtgtccatcatctgactcttctcggagtctcatattttgtgggactcctgtgcaaacatatgttattaaaatttttttcctcctgt

SEQ ID NO: 185102 - DNA, 3169 bp, Homo sapiens
  Payload ID: 16446
  Gene Symbol: SP140
  Gene Name: SP140 nuclear body protein
  Uniprot ID: Q13342
  ENST ID: ENST00000420434
  CDS Start-End: 116-2638
acttttcttttcctctttgactgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggatggtcgcagagatccagaacgtagagggtcagaacctgcaggagcaggtttgccctgagcccattttcaggttcttcagagaaaacaaggtggagattgcaagtgcaataacaaggccatttcctttccttatgggcctccgagaccgctccttcatctccgagcagatgtatgaacattttcaagaagcttttagaaacctggtcccagtgacaagagtgatgtattgtgtactcagtgaactggagaagacatttggctggtcacatctggaagcattgttcagcaggattaacctgatggcctatcctgatttaaacgagatttacagaagcttccagaatgtatgctatgaacactcacctctccaaatgaataatgtaaacgatttagaagatagacccagattactaccatatggtaaacaagagaacagcaatgcctgtcatgaaatggatgatatagcagtgcctcaggaagccttgagctcctcgccaaggtgtgagccaggtttctcttcagagtcttgtgagcagttagctctcccaaaggctggtggaggagatgctgaagatgcacccagcctactaccaggtgggggagtgtcctgtaaacttgctatacaaatagatgaaggagaatcagaagaaatgcccaagttactgccttatgatacagaagttctagaaagcaacgggatgatagatgcggcaaggacatacagcacagcaccaggggagaaacagggagaggaggaaggcaggaacagtcccagaaaaagaaaccaagacaaggagaagtaccaagagagtccagagggaagagacaaagagacctttgatctaaaaactccccaagtcactaatgaaggagaaccagagaaggggctctgtctactaccaggtgaaggagaagagggcagtgatgactgttcagaaatgtgtgatggagaagagccccaggaagcctctagctccctagcaagatgtgggtcagtttcttgtttatctgcagagacctttgatctaaagactccccaagtcactaatgaaggagaaccagagaaggagctcagtctactaccaggtgaaggagaagtgtctagtgaactagaaaatcacccaatgaatgaagaaggagaatcagaagagcttgcttctagcctgctatatgataatgtaccaggagcggagcaatcagcatatgaaaatgagaagtgttcctgtgtcatgtgtttctcagaagaggtgccaggaagcccagaagcaaggacggaaagtgatcaagcgtgtggcacaatggatactgtggatattgcaaacaactccactttgggaaaacccaagaggaaaagaagaaaaaagagggggcatggctggagcagaatgagaatgagaaggcaggaaaacagccaacaaaatgataatagcaaagccgacggccaggtggtctccagtgaaaagaaggcgaacgtgaatctgaaagacctttccaagattagggggagaaagagaggcaaacctggaacccgcttcactcagagtgacagagctgcacagaaaagagtccgatcaagagcttcaagaaagcacaaagatgaaactgtggattttaaggctcctttgcttccagtgacctgtggtggggtgaagggaattttacataagaagaaattgcagcaaggaatcttggtgaagtgtatacagactgaggatggaaaatggttcacccccacggaatttgaaatcaaaggaggccatgcaagatcaaagaactggaggctgagtgtgcgctgtggcgggtggcccctacgatggctgatggagaatggatttctgcctgatcctccaagaatacgttacaggaaaaaaaagagaatactgaagtctcaaaacaatagctcagttgacccttgtatgagaaacctggatgagtgtgaggtgtgccgggacggaggggagctgttctgttgcgacacttgttcaagagtcttccatgaggactgtcacatcccgcctgtggaagctgagaggaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtacaaggattttggccaaatgggatttagactggaggctgagtttgagaagaatttcaaggaagtgtttgctattcaggaaacaaatgggaacaattgactggattagtggatgctgaaagcattcagcaaatggcaccctaaaatatgccgctggtttgccactgacttcaaaatgaggtcacttgggcacagcacatgcagggaggggcttttctctgagcctccttcatctgcccaaagacaaatcctcaaaaggaaattcaatcatcatgaatcacaaccccaagtatctcatcagccagggaagagtaagtgggatcacagggaaggatgttggcagcgacaccatcccatacaggctcttacctcttctcctgagggctgctccagacaacatttattacccagaagaccttttgtctgaaaaccagccaagctttattcaggacacacttcttgccttcactttcccacttccgtggccacctccatgcagaagccctaagcccacattctttcgatagctcacggtggtgcatgagtgtccatcatctgactcttctcggagtctcatattttgtgggactcctgtgcaaacatatgttattaaaatttttttcctcctgtt

SEQ ID NO: 185103 - DNA, 580 bp, Homo sapiens
  Payload ID: 16446
  Gene Symbol: SP140
  Gene Name: SP140 nuclear body protein
  ENST ID: ENST00000456542
  CDS Start-End: 493-580
gtgtgtggtacaagagatttccaaaagtttctaggtgccttcagtgggcaaagtgcaaggtattaaaaaaactgagagggaaggaccctgccaagaaggcggctaccatgagggagagatggaaggtgaggctgagacccagaggaggtgcaatgccagagggtgcagagaagtaaatggtctcaaccagtgaatggaaaaaggaaagtaacttcaaattttggaaagggattcagaacaaaatcatcaggttgaagatcccggaagatgactgaagctcagccagggggaagccttttgatggtgaagtgtcagagagcaaaggaggaactgtcaacaatggtgattccactaatgaaaatatccaatgtgagctggtggtcctttgcttgttgttctgagcaccgaggggcagttggcagcttcacctcagagctgcaggaaggaacggggcagtgaaaatcgaatcgggtgtgatcctaggccaagctcatggcccagcagggccagcaggggcagatggcaagtggagacagcaatctcaacttcaggtttccacaaatgctgtggtctgttgtag

SEQ ID NO: 185104 - DNA, 2502 bp, Homo sapiens
  Payload ID: 16447
  Gene Symbol: SP140L
  Gene Name: SP140 nuclear body protein-like
  ENST ID: ENST00000243810
  CDS Start-End: 1-1668
atggcaggtgggggcagcgacctgagcaccaggctgttcacggaagaccaggatgtagatgagggacttgtctatgacactgtattcaagcacttcaaaagacataagctggagatatcaaatgcaataaaaaagacatttccattccttgagggcctccgcgatcgggaactcatcacaaataaaatgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagaaaaaagaaggggcatggctggagcagaatgggaacgagaacgcagaaaaacaaccaacaaaatgataacagcaaagccgatggccagctggtctcgagtgaaaagaaggcgaacatgaatctgaaagacctttccaagattagggggagaaagagaggcaaacctggaacccactttactcagagtgacagagctccacagaaaagagtccgatcaagagcttcaagaaagcacaaagatgaaactgtggattttcaggctcctttacttccagtgacctgtggtggggtgaagggaattttacataaggagaaattggaacaaggaaccttggcaaagtgtatacagactgaggatggaaaatggttcacccccatggaatttgaaatcaaaggaggctacgcaagatcaaagaactggaggctgagtgtgcgctgtggcgggtggcccctacgacggctgatggaggaaggatctctacctaatcctccaagaatatattacaggaacaaaaagagaatactgaagtctcaaaacaatagctcagttgacccttgtatgagaaacttggatgagtgtgaggtgtgccgggacggaggggagctgttctgttgcgacacttgttcaagagtcttccatgaggactgccacatcccacctgtggaaagtgagaagaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtataaggattttggccaaatgggacttagactggaggctgaatttgagaaggatttcaaggaagtgtttgctattcaggaaacaaatgggaacagttgactggtttagtggatgctgaaggccttcaggaaatatgctactggttgccactgacttcaaactgagagcacttgggaaatagcacatgcagggagaggcttttctctgagcctccctcatctgcccaaaaacaaatcctcaaaagaaatttgatcatcatgaatcccatccccaagaatctcatcaaccagggaagaggaactgagatcacagggaaggagattggaggtgataccagcacagacagactctcacctcttctcctgaggtctgctccagacaacatttattactcacaagacctttttcctccgttttttttttgagatggagtctcacacagtcacccgggattggaatgcaatggcgcgatctcagctcactgcaacctctgcctcccggattcaagtgattctcctgtctcagcctcccaagtagctgggattacagtgcctgccaccatgcccagctaattttttgcatttttagtagagacggggtttcactatgttggccaggctggtctcgaactcctgacctcatgagccgcccgccttggcctcccaaagtgctgggacgtgacaggagtgagccaccacacctggccactcgcaagaccttttatctgaaaaccagccaagctttattcacgacacacttcttcccttcactctcccacttctgtggtcaactccctgcagaactcccaaactgccgttcttttcgatagctcacgatggtgtatgagtgtcaatcatctgacccttcttggagtctcatatttcgtggaactcctgtgcaaacatatattattaaattttttttcctcctgtc

SEQ ID NO: 185105 - DNA, 2397 bp, Homo sapiens
  Payload ID: 16447
  Gene Symbol: SP140L
  Gene Name: SP140 nuclear body protein-like
  ENST ID: ENST00000396563
  CDS Start-End: 1-1563
atggcaggtgggggcagcgacctgagcaccaggctgttcacggaagaccaggatgtagatgagggacttgtctatgacactgtattcaagcacttcaaaagacataagctggagatatcaaatgcaataaaaaagacatttccattccttgagggcctccgcgatcgggaactcatcacaaataaaatgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagaaaaaagaaggggcatggctggagcagaatgggaacgagaacgcagaaaaacaaccaacaaaatgataacagcaaagccgatggccagctggtctcgagtgaaaagaaggcgaacatgaatctgaaagacctttccaagattagggggagaaagagaggcaaacctggaacccactttactcagagtgacagagctccacagaaaagagtccgatcaagaggaaccttggcaaagtgtatacagactgaggatggaaaatggttcacccccatggaatttgaaatcaaaggaggctacgcaagatcaaagaactggaggctgagtgtgcgctgtggcgggtggcccctacgacggctgatggaggaaggatctctacctaatcctccaagaatatattacaggaacaaaaagagaatactgaagtctcaaaacaatagctcagttgacccttgtatgagaaacttggatgagtgtgaggtgtgccgggacggaggggagctgttctgttgcgacacttgttcaagagtcttccatgaggactgccacatcccacctgtggaaagtgagaagaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtataaggattttggccaaatgggacttagactggaggctgaatttgagaaggatttcaaggaagtgtttgctattcaggaaacaaatgggaacagttgactggtttagtggatgctgaaggccttcaggaaatatgctactggttgccactgacttcaaactgagagcacttgggaaatagcacatgcagggagaggcttttctctgagcctccctcatctgcccaaaaacaaatcctcaaaagaaatttgatcatcatgaatcccatccccaagaatctcatcaaccagggaagaggaactgagatcacagggaaggagattggaggtgataccagcacagacagactctcacctcttctcctgaggtctgctccagacaacatttattactcacaagacctttttcctccgttttttttttgagatggagtctcacacagtcacccgggattggaatgcaatggcgcgatctcagctcactgcaacctctgcctcccggattcaagtgattctcctgtctcagcctcccaagtagctgggattacagtgcctgccaccatgcccagctaattttttgcatttttagtagagacggggtttcactatgttggccaggctggtctcgaactcctgacctcatgagccgcccgccttggcctcccaaagtgctgggacgtgacaggagtgagccaccacacctggccactcgcaagaccttttatctgaaaaccagccaagctttattcacgacacacttcttcccttcactctcccacttctgtggtcaactccctgcagaactcccaaactgccgttcttttcgatagctcacgatggtgtatgagtgtcaatcatctgacccttcttggagtctcatatttcgtggaactcctgtgcaaacatatattattaaattttttttcctcctgtc

SEQ ID NO: 185106 - DNA, 1781 bp, Homo sapiens
  Payload ID: 16447
  Gene Symbol: SP140L
  Gene Name: SP140 nuclear body protein-like
  Uniprot ID: Q9H930
  ENST ID: ENST00000444636
  CDS Start-End: 87-1403
agggcagccacactgcacgcaggctgggccgactggggagctcataggccaggctctgacacccaggcagggcctagggtgggacgatggcaggtgggggcagcgacctgagcaccagggggctgaacggaggtgtttcacaagtagcaaatgagatgaaccatcttcctgcacacagccaaagtctgcaaaggctgttcacggaagaccaggatgtagatgagggacttgtctatgacactgtattcaagcacttcaaaagacataagctggagatatcaaatgcaataaaaaagacatttccattccttgagggcctccgcgatcgggaactcatcacaaataaaatgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagaaaaaagaaggggcatggctggagcagaatgggaacgagaacgcagaaaaacaaccaacaaaatgataacagcaaagccgatggccagctggtctcgagtgaaaagaaggcgaacatgaatctgaaagacctttccaagattagggggagaaagagaggcaaacctggaacccactttactcagagtgacagagctccacagaaaagagtccgatcaagagcttcaagaaagcacaaagatgaaactgtggattttcaggctcctttacttccagtgacctgtggtggggtgaagggaattttacataaggagaaattggaacaaggaaccttggcaaagtgtatacagactgaggatggaaaatggttcacccccatggaatttgaaatcaaaggaggctacgcaagatcaaagaactggaggctgagtgtgcgctgtggcgggtggcccctacgacggctgatggaggaaggatctctacctaatcctccaagaatatattacaggaacaaaaagagaatactgaagtctcaaaacaatagctcagttgacccttgtatgagaaacttggatgagtgtgaggtgtgccgggacggaggggagctgttctgttgcgacacttgttcaagagtcttccatgaggactgccacatcccacctgtggaaagtgagaagtaagtgacatgcaggcacctctctttcatcctttaagggaccttccacctgccatgcgcactctccagcagaatgtctgcttgtgtctagatggggaaggagcaggttcatcgggtactgggacccagcagtgtgatccagagagcagtgggagacgctggcagcaggaggtaaatgctctctgtgctctcagggacacctcctctgatatgctgaggccagtgttggggacctttgcctacatactggtattgtcctttccttgaagttttgcagtagggtctcctgtcccagggggttgaggaaaaaaaacaccagttgtttatattttgtgcttattcatacaagacaggaagcacggtcttaggcggatggaggcct

SEQ ID NO: 185107 - DNA, 1727 bp, Homo sapiens
  Payload ID: 16447
  Gene Symbol: SP140L
  Gene Name: SP140 nuclear body protein-like
  Uniprot ID: Q9H930
  ENST ID: ENST00000458341
  CDS Start-End: 259-648
ggcgggcgcccctcccccagcgtcactgccgccttgcagtttgatctcagactgctgtgctagcaatcagtgagagtccgtgggcgtaggaccttccgagccaggctgttcacggaagaccaggatgtagatgagggacttgtctatgacactgtattcaagcacttcaaaagacataagctggagatatcaaatgcaataaaaaagacatttccattccttgagggcctccgcgatcgggaactcatcacaaataaaatgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagtaagaataaataagaatttacttgcttttgatgttacaaatacatttttaatgccagagttttctttttgtcattgttactgtttctgttattatttgcaatactgtggtagagagaatgatggccaccccaaaaaacgtccacctcctaatccctggacctgtaatctgctatcttacatggcaaacgggactttacagatacaattaatttagagaccttgaaatggggagatgatcctgggttatgtggtgggcccaatctaatcttgtaggctttaaagagtggagaacttttcctggctgtggagaaaggaaaatgtgactatggaagagtcatcagaaacatgtaatgttgcaggctttgaagatggaagagggaaccaaggaatgtggatgacctctagaagctgaaaaaacaaggaaatagtttgtcctttccagcccccagaaaggaatgaaggcctacaccttgactttaggcagtaagacccgtgtcacacttctcactgacataactggaagataatatatttgtgttgttttaaaccactaaatttgtggtaatttgttatggcagcaattaagagtaatacggattttagtacttggcagtggggtgtggctatcacatattcctgaaagtgttggggtgtctttgagattgcgcagtggaaagaggttggaagaattttaaatagagtgataggaaaatcctagatgaaaaaatggaaattaagtcaattaataaccctacaatggcctgtaagtgctcaagttaaagaaagagtcggccgggcgcggtggctcacgcctgtaatcctagcactttgggaggccgagacgggcggatcacgaggtcaggagatcgagaccatcttggctaacacggtgaaaccccgtttctactaaaaatacaaaaaattagccgggcgtgttggcgggcacctgtagtcccagctgcttgggaggctgaggcaggagaatggcatgaacctgggaggcggagcttgcagtgagccaggatcgcgccactgcactccaacctgggagacacagcgagactccgtctcaaaaaaaaaaaaaaaaaaaa

SEQ ID NO: 185108 - DNA, 2665 bp, Homo sapiens
  Payload ID: 16447
  Gene Symbol: SP140L
  Gene Name: SP140 nuclear body protein-like
  Uniprot ID: Q9H930
  ENST ID: ENST00000415673
  CDS Start-End: 87-1829
agggcagccacactgcacgcaggctgggccgactggggagctcataggccaggctctgacacccaggcagggcctagggtgggacgatggcaggtgggggcagcgacctgagcaccagggggctgaacggaggtgtttcacaagtagcaaatgagatgaaccatcttcctgcacacagccaaagtctgcaaaggctgttcacggaagaccaggatgtagatgagggacttgtctatgacactgtattcaagcacttcaaaagacataagctggagatatcaaatgcaataaaaaagacatttccattccttgagggcctccgcgatcgggaactcatcacaaataaaatgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagaaaaaagaaggggcatggctggagcagaatgggaacgagaacgcagaaaaacaaccaacaaaatgataacagcaaagccgatggccagctggtctcgagtgaaaagaaggcgaacatgaatctgaaagacctttccaagattagggggagaaagagaggcaaacctggaacccactttactcagagtgacagagctccacagaaaagagtccgatcaagagcttcaagaaagcacaaagatgaaactgtggattttcaggctcctttacttccagtgacctgtggtggggtgaagggaattttacataaggagaaattggaacaaggaaccttggcaaagtgtatacagactgaggatggaaaatggttcacccccatggaatttgaaatcaaaggaggctacgcaagatcaaagaactggaggctgagtgtgcgctgtggcgggtggcccctacgacggctgatggaggaaggatctctacctaatcctccaagaatatattacaggaacaaaaagagaatactgaagtctcaaaacaatagctcagttgacccttgtatgagaaacttggatgagtgtgaggtgtgccgggacggaggggagctgttctgttgcgacacttgttcaagagtcttccatgaggactgccacatcccacctgtggaaagtgagaagaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtataaggattttggccaaatgggacttagactggaggctgaatttgagaaggatttcaaggaagtgtttgctattcaggaaacaaatgggaacagttgactggtttagtggatgctgaaggccttcaggaaatatgctactggttgccactgacttcaaactgagagcacttgggaaatagcacatgcagggagaggcttttctctgagcctccctcatctgcccaaaaacaaatcctcaaaagaaatttgatcatcatgaatcccatccccaagaatctcatcaaccagggaagaggaactgagatcacagggaaggagattggaggtgataccagcacagacagactctcacctcttctcctgaggtctgctccagacaacatttattactcacaagacctttttcctccgttttttttttgagatggagtctcacacagtcacccgggattggaatgcaatggcgcgatctcagctcactgcaacctctgcctcccggattcaagtgattctcctgtctcagcctcccaagtagctgggattacagtgcctgccaccatgcccagctaattttttgcatttttagtagagacggggtttcactatgttggccaggctggtctcgaactcctgacctcatgagccgcccgccttggcctcccaaagtgctgggacgtgacaggagtgagccaccacacctggccactcgcaagaccttttatctgaaaaccagccaagctttattcacgacacacttcttcccttcactctcccacttctgtggtcaactccctgcagaactcccaaactgccgttcttttcgatagctcacgatggtgtatgagtgtcaatcatctgacccttcttggagtctcatatttcgtggaactcctgtgcaaacatatattattaaattttttttcctcctgtcaa

SEQ ID NO: 185109 - DNA, 3112 bp, Homo sapiens
  Payload ID: 16448
  Gene Symbol: SP2
  Gene Name: Sp2 transcription factor
  Uniprot ID: Q02086
  ENST ID: ENST00000376741
  CDS Start-End: 138-1979
aatgttccaagcgcttattggtgaaggctgccgtcgctcgggcggtggcgggctccgggattggcggttgcttggcgggcggtgtcaggctctcggtggcggcggaggcggcggaggccagggaggaagatgtcgtaatgagcgatccacagaccagcatggctgccactgctgctgtgagtcccagtgactacctgcagcctgccgcctccaccacccaggactcccagccatctcccttagccctgcttgctgcaacatgtagcaaaattggccctccagcagttgaagctgctgtgacacctcctgctcccccacagcccacaccgcggaaacttgtccctatcaaacctgcccctctccctctcagccccggcaagaatagctttggaatcttgtcctccaaaggaaatatacttcagattcaggggtcacaactgagcgcctcctatcctggagggcagctggtgttcgctatccagaatcccaccatgatcaacaaagggacccgatcaaatgccaatatccagtaccaggcggtccctcagattcaggcaagcaattcccaaaccatccaagtacagcccaatctcaccaaccagatccagatcatccctggcaccaaccaagccatcatcaccccctcaccgtccagtcacaagcctgtccccatcaagccagcccccatccagaagtcgagtacgaccaccacccccgtgcagagcggggccaatgtggtgaagctgacaggtgggggcggcaatgtgacgctcactctgcccgtcaacaaccttgtgaacgccagtgacaccggggcccctactcagctcctcactgaaagccccccaaccccgctgtctaagactaacaagaaagcaaggaagaagagccttcctgcctcccagccccctgtggctgtggctgagcaggtggagacggtgctgatcgagaccaccgcggacaacatcatccaggcaggaaataacctgctcattgttcagagccctggtgggggccagccagctgtggtccagcaggtccaggtggtgccccccaaggccgagcagcagcaggtggtacagatcccccagcaggctctgcgggtggtgcaggcggcatctgccaccctccccactgtaccccagaagccctcccagaactttcagatccaggcagctgagccgacacctactcaggtctacatccgcacgccttccggtgaggtgcagacagtccttgtccaggacagccccccagcaacagctgcagccacctctaacaccacctgtagcagccctgcatcccgtgctccccatctgagtgggaccagcaaaaagcactcagctgcaattctccgaaaagagcgtcccctgccaaagattgccccagccgggagcatcatcagcctgaatgcagcccagttggcggcagctgcccaggcaatgcagaccatcaacatcaatggtgtccaggtccagggcgtgcctgtcaccatcaccaacacaggcgggcagcagcagctgacagtgcagaatgtttctgggaacaacctgaccatcagtgggctgagccccacccagatccagctgcaaatggaacaagccctggccggagagacccagcccggggagaagcggcgccgcatggcctgcacgtgtcccaactgcaaggatggggagaagaggtctggagagcagggcaagaagaagcacgtgtgccacatccccgactgtggcaagacgttccgtaagacgtccttgctgcgtgcccatgtgcgcctgcacactggcgagcggccctttgtctgcaactggttcttctgtgggaagaggttcacacggagtgacgagctccaacggcatgctcgcacccacacaggggacaaacgcttcgagtgcgcccagtgtcagaagcgcttcatgaggagtgaccacctcaccaagcattacaagacccacctggtcacgaagaacttgtaaggccaactgcggcgggaggccctgaagatgcagtcccccacctgtgtcctccctgggcccctggtggaaaggagccctgtggctgccttgggcctgccctcagccccactcctgttctgcaactgtccccacaggaaggggctctgttccctgtattgtcctccttctgaagccccttggctctgccttggcccttcccctcaccacgagctcccggcctgcccagactgtggacactggccgtgcccaatgagacgttctaaaccaggacgcgtgggaacccttatttccaaaggaaaaacatgcatttcactccgtcgaggagcaaagtgagcccctaccccccaccccgatccccgctcccaacactgccggagtcgcgtcatgccatgccccctctcctgcacctccctggccctgccggccactgtggacgccctggggcttggcacccacctctggagaaactcggggccacctccactccatgtgcccagccccgccacaacctctcctccagcacattccagctctatttaaaaagtaaagacacccaccgactcctgatccccctctttttctatggagaacgttgccttatactctacttcagatgatgaacactgtgtactgtgtgtgctttaaagaagttttatttaattgctcccttcttcctttccttgttattcacctccctgatgcctgctttcagttgagggttgggggcaatgatgagcatatgaattttttctcactctagcaattcccttttctaaatgacacagcatttaaactcaaatctggattcagataacagcacctgcacatcctgcacctcctccctctcccttcacctcacccctgcccggcccaagctctacttgtgtacagtgtatattgtataatagacaattgtgtctactacatgtttaaaaacacattgcttgttatttttgaggcttttaaattaaacaaaaatccaactttatttttagttgtaactgcttgaggtatgttttatgaattaagtgacagatttgttatcctttattaacgtactttgttggtcagcactgggctgacaaaaattttttcttgctaataaatttagttgcctgaggcaaaatcttcaa

SEQ ID NO: 185110 - DNA, 908 bp, Homo sapiens
  Payload ID: 16448
  Gene Symbol: SP2
  Gene Name: Sp2 transcription factor
  ENST ID: ENST00000613139
  CDS Start-End: 159-908
aatgttccaagcgcttattggtgaaggctgccgtcgctcgggcggtggcgggctccgggattggcggttgcttggcgggcggtgtcaggctctcggtggcggcggaggcggcggaggccagggaggaagatgtcgtaatgagcgatccacagaccagcatggctgccactgctgctgtgagtcccagtgactacctgcagcctgccgcctccaccacccaggactcccagccatctcccttagccctgcttgctgcaacatgtagcaaaattggccctccagcagttgaagctgctgtgacacctcctgctcccccacagcccacaccgcggaaacttgtccctatcaaacctgcccctctccctctcagccccggcaagaatagctttggaatcttgtcctccaaaggaaatatacttcagattcaggggtcacaactgagcgcctcctatcctggagggcagctggtgttcgctatccagaatcccaccatgatcaacaaagggacccgatcaaatgccaatatccagtaccaggcggtccctcagattcaggcaagcaattcccaaaccatccaagtacagcccaatctcaccaaccagatccagatcatccctggcaccaaccaagccatcatcaccccctcaccgtccagtcacaagcctgtccccatcaagccagcccccatccagaagtcgagtacgaccaccacccccgtgcagagcggggccaatgtggtgaagctgacaggtgggggcggcaatgtgacgctcactctgcccgtcaacaaccttgtgaacgccagtgacaccggggcccctactcagctcctcactgcttcctgccaaactgggatgctgaattcaacaagaatgttcttatttttggcatttattaatgtgctctaa

SEQ ID NO: 185111 - DNA, 6359 bp, Homo sapiens
  Payload ID: 16449
  Gene Symbol: SP3
  Gene Name: Sp3 transcription factor
  Uniprot ID: Q02447
  ENST ID: ENST00000310015
  CDS Start-End: 532-2877
gggacgaatttcctccccagctcagctcccctacagcttggctaggcctgctccgagcgcctgcaaggtggaggaggcctgcgcctcgggcctggcagcggcagccggcgagggaggcgggcacagcggggtaaccggcgagccgtagccgctctcgaaaacctacgctgccacggccgctcattgtctctccccttccacccgggggcaaacaggaagcgcgccgcctggcagaccgacggacaggcgcctggaccaatgagcacagccgacaaagagcacggcggcgaatgagagccaagaagaggggcgggagttccgggcgggctgtcaccctcttccccccttttgggctggaggctccaccttttgtgtttcccgcacagtcaatcaaaataggaaaaaaaaatccccggaccgctccggccgtgtccgccgccgcttcccgcatcctctcccgccgccgccgccttcgctcctcaccatgtgtaaggcggcggggagccccgcctgaggtgccctaaacacactatgaccgctcccgaaaagcccgtgaaacaagaggaaatggctgccttggacgtggatagcggcggcggcggtggcggcggcggcggccacggcgagtatctgcagcagcagcaacagcacggaaacggtgcggtggcggcggcagcggcggcccaggacactcagccgtcaccgctcgctctgctggccgctacctgcagcaagatagggccgccatcgccgggcgacgacgaggaggaggcggccgccgcagccggggcccccgccgccgccggagcgacaggtgatttggcttctgcacagttaggaggagcaccaaaccgatgggaggttttgtcagccacacctacaactataaaagatgaagctggtaatctagtccagattccaagtgctgctacttcaagtgggcagtatgttcttccccttcagaatttgcagaatcaacaaatattttccgttgcaccaggatcagattcatcaaatggtacagtgtccagtgttcaatatcaagtgataccacagatccagtcagcagatggtcagcaggttcaaattggtttcacaggctcttcagataatgggggtataaatcaagaaagcagtcaaattcagatcattcctggctctaatcaaaccttacttgcctctggaacaccttctgctaacatccagaatctcataccacagactggtcaagtccaggttcagggagttgcaattggtggttcatcttttcctggtcaaacccaagtagttgctaatgtgcctcttggtctgccaggaaatattacgtttgtaccaatcaatagtgtcgatctagattctttgggactctcgggcagttctcagacaatgactgcaggcattaatgccgacggacatttgataaacacaggacaagctatggatagttcagacaattcagaaaggactggtgagcgggtttctcctgatattaatgaaactaatactgatacagatttatttgtgccaacatcctcttcatcacagttgcctgttacgatagatagtacaggtatattacaacaaaacacaaatagcttgactacatctagtgggcaggttcattcttcagatcttcagggaaattatatccagtcgcctgtttctgaagagacacaggcacagaatattcaggtttctacagcacagcctgttgtacagcatctacaacttcaagagtctcagcagccaaccagtcaagcccaaattgtgcaaggtattacaccacagacaatccatggtgtgcaagccagtggtcaaaatatatcacaacaggctttgcaaaatcttcagttgcagctgaatcctggaacctttttaattcaggcacagacagtgaccccttctggacaggtaacttggcaaacgtttcaagtacaaggggtccagaacttgcagaatttgcaaatacagaatactgctgcccaacaaataactttgacgcctgttcaaaccctcacacttggtcaagttgcggcaggtggagccttcacttcaactccagttagtctaagcactggtcagttgccaaatctacaaacagttacagtgaactctatagattctgctggtatacagctacatccaggagagaatgctgacagtcctgcagatattaggatcaaggaagaagaacctgatcctgaagagtggcagctcagtggtgattctaccttgaataccaatgacctaacacacttaagagtacaggtggtagatgaagaaggggaccaacaacatcaagaaggaaaaagacttcggagggtagcttgcacctgtcccaactgtaaagaaggtggtggaagaggtaccaatcttgggaaaaagaagcaacacatttgtcatataccaggatgtggtaaagtctatgggaagacctcacatctgagagctcatctgcgttggcattctggagaacgcccttttgtttgtaactggatgtactgtggtaaaagatttactcgaagtgatgaattacagaggcacagaagaacacatacaggtgagaagaaatttgtttgtccagaatgttcaaaacgctttatgagaagtgaccaccttgccaaacatattaaaacacaccagaataaaaaaggtattcactctagcagtacagtgctggcatctgtggaagctgcgcgagatgatactttgattactgcaggaggaacaacgcttatccttgcaaatattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaatttttggattgacagtaacttggttatacatgacactgaaatgccttactttgtatgatattccatagtatattaaaaatggtaaaattgcatgggttttgtaggtacttttggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaaaaaagtttaaaatgtataagttgaggcatttgggtggtaagagaatgttatagtgaattatcccttttcttgactattggaggaccaaaaaaataaggtgtattgcgtcttagcagtgatttttatccaatcttgtttccaaaaaccatgtctcccagggccttaaaagccatcatgtaaattaccagtaaagtgtaacatatgcaaacataacaaaatcacttccatagtgacgatactccaaccatatggatattagtcatagaagaactagaggttttatgatatttttttaagtcttttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtcttgtaagagctatacagttttcctaaatgtatacctgtaactgcagcagttcacctatttcaaaaatttggaattctgttcatttgttattcttaagaccacctcaaatttaaaggctaccttattgtacgtttaaagtgtattataacagtgtggtagttaataaaacactatttttttttcttttgagtttgttgtattcctatgcataaaaaatattgcagtggtatggggtaagaattggtggtttatttttcttcaacttggctttttatttttagattcttgattttagacactgaattgtaaacaggcatttatttgaagaagagatatatagagacactggtcatttactaattttttacctagagtaaataagaatgagcttattaaataaaatttttgaaaaaaagtcttagcccttagcccacattgattcatatcagttttatcagtaccattttgcaatttttttgttttccgttttaaagcaatgcagaatattttgatttatcgaaaacctgaatttacattaagactcctgaaaatgataagacaagcgttggtaaccatggcaggagttacttgaaaaagttgcctttgaatttgcatgtgtttcatcattataaaggcagagtaggaggaaagagtattaatgtgattgtgtattgtagatgttttaaagtaaaaatcaagtttcttaacacatgtatacagtgggggtaaagatgtccattttctgttttccaggcccagtctgactctgtctgtaatacctgattgcattggagaactctagacacgcataaacatggacagtttttctaaatgtgagacttaagcctgtgatgtaaaataggaagttctacttggaataatataaaggaaccactagaatttacaattattttgaagttacagggattagattttgaatcttaaaatcctttaggtaatttttagaatttttaaattaagattaatgtgaagagaattaagtgagcagcaggtggttcacttgagcaaactgcccattaagtcagattaaaccatttgaatgatagtagagatgttttaagtaatactggatttttacagtaagtttatggtgtactttgaatcgataggtgtccatgcatattttatgaattcgtggagaatgaatgcaatgaagaaagtaagtagtcttgaaaattatttaaataaagttgtagatttttttagtgccccctaggaatatattagtgaactttggaacttttaccaaagttatgtaacctcagtgtagataattttaaatatttctatttttatattttaaaatgttgaatatactctggaaacaacatttgaagatttgctctgatgtcaactttttctggttataaaacctattagtattgtgtataattctcagggtaggtatactctaataggtgttttgtcaattgctttatttttgtaaaggctagagttagtgcatattgaatatatttatgtacaaataattcctgttgtaacatttagtggacgcgattatctgtatacctcaaattttaatttaagaaagtatcacttaaagagcatctcattttctatagattgaggcttaattactgaaaagtgactcaaccaaaaagcacataaccttttaaaggagctacacctaccgcagaaagtcagatgccctgtaaataactttggtctttcaaaatagtggcaatgcttaagatacttaaaaatacacatacatataagctgaaagcatgtcaagcctatttcatagaaaatagttcttaaacagtattgttcattagaaattgctggggagcattttagagattccataggcctggtagccacctcagcttactaaatcaacatctctggagatggagtgtatatgtgttttgaaacagctgctcaagtggttctgttaaacactcctgcgttacaatcacttaaaatagagcaagcatccccttaggctcttaattgtagtttaaattccagtactgcctactcagacccaaaagttttgttttatgaaaaatttgtattgtgttcaatattgtttgaaatttggggttgttgcataaatgattatggaataacatttggttttaaaataatataaactgacatgttatgctacctgttacacaatttggttttcagttttaattatatgaagctggtaacaatcgtttttgttgtaaaagaattatttttcactaaacagtatgtttaaaactga

SEQ ID NO: 185112 - DNA, 3937 bp, Homo sapiens
  Payload ID: 16449
  Gene Symbol: SP3
  Gene Name: Sp3 transcription factor
  ENST ID: ENST00000418194
  CDS Start-End: 385-2526
cctcgcccgcctgccgcctttttgtgcgcgtgtgagtgtgggccccagcgtgccctcccgggggtgggttccgggcggaaggcggaggcccggcgcgcagcccgccgcccgcctgcccgcggaccggggagccggggtgcttggagcgggggacgccaggcgtgggctggcggcgggaccaggaggaggaggaggaggaggaggagagcgcgggctggcgcttgcccgggcgcagtcggcggggaccgagtcgtacttcctgtgcgaaaggcggcccgaccctaaccgccaccccctccccctgtctccctctctgaacccgcccattgggggtaggacactcagccgtcaccgctcgctctgctggccgctacctgcagcaagatagggccgccatcgccgggcgacgacgaggaggaggcggccgccgcagccggggcccccgccgccgccggagcgacaggtgatttggcttctgcacagttaggaggagcaccaaaccgatgggaggttttgtcagccacacctacaactataaaagatgaagctggtaatctagtccagattccaagtgctgctacttcaagtgggcagtatgttcttccccttcagaatttgcagaatcaacaaatattttccgttgcaccaggatcagattcatcaaatggtacagtgtccagtgttcaatatcaagtgataccacagatccagtcagcagatggtcagcaggttcaaattggtttcacaggctcttcagataatgggggtataaatcaagaaagcagtcaaattcagatcattcctggctctaatcaaaccttacttgcctctggaacaccttctgctaacatccagaatctcataccacagactggtcaagtccaggttcagggagttgcaattggtggttcatcttttcctggtcaaacccaagtagttgctaatgtgcctcttggtctgccaggaaatattacgtttgtaccaatcaatagtgtcgatctagattctttgggactctcgggcagttctcagacaatgactgcaggcattaatgccgacggacatttgataaacacaggacaagctatggatagttcagacaattcagaaaggactggtgagcgggtttctcctgatattaatgaaactaatactgatacagatttatttgtgccaacatcctcttcatcacagttgcctgttacgatagatagtacaggtatattacaacaaaacacaaatagcttgactacatctagtgggcaggttcattcttcagatcttcagggaaattatatccagtcgcctgtttctgaagagacacaggcacagaatattcaggtttctacagcacagcctgttgtacagcatctacaacttcaagagtctcagcagccaaccagtcaagcccaaattgtgcaaggtattacaccacagacaatccatggtgtgcaagccagtggtcaaaatatatcacaacaggctttgcaaaatcttcagttgcagctgaatcctggaacctttttaattcaggcacagacagtgaccccttctggacaggtaacttggcaaacgtttcaagtacaaggggtccagaacttgcagaatttgcaaatacagaatactgctgcccaacaaataactttgacgcctgttcaaaccctcacacttggtcaagttgcggcaggtggagccttcacttcaactccagttagtctaagcactggtcagttgccaaatctacaaacagttacagtgaactctatagattctgctggtatacagctacatccaggagagaatgctgacagtcctgcagatattaggatcaaggaagaagaacctgatcctgaagagtggcagctcagtggtgattctaccttgaataccaatgacctaacacacttaagagtacaggtggtagatgaagaaggggaccaacaacatcaagaaggaaaaagacttcggagggtagcttgcacctgtcccaactgtaaagaaggtggtggaagaggtaccaatcttgggaaaaagaagcaacacatttgtcatataccaggatgtggtaaagtctatgggaagacctcacatctgagagctcatctgcgttggcattctggagaacgcccttttgtttgtaactggatgtactgtggtaaaagatttactcgaagtgatgaattacagaggcacagaagaacacatacaggtgagaagaaatttgtttgtccagaatgttcaaaacgctttatgagaagtgaccaccttgccaaacatattaaaacacaccagaataaaaaaggtattcactctagcagtacagtgctggcatctgtggaagctgcgcgagatgatactttgattactgcaggaggaacaacgcttatccttgcaaatattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaatttttggattgacagtaacttggttatacatgacactgaaatgccttactttgtatgatattccatagtatattaaaaatggtaaaattgcatgggttttgtaggtacttttggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaaaaaagtttaaaatgtataagttgaggcatttgggtggtaagagaatgttatagtgaattatcccttttcttgactattggaggaccaaaaaaataaggtgtattgcgtcttagcagtgatttttatccaatcttgtttccaaaaaccatgtctcccagggccttaaaagccatcatgtaaattaccagtaaagtgtaacatatgcaaacataacaaaatcacttccatagtgacgatactccaaccatatggatattagtcatagaagaactagaggttttatgatatttttttaagtcttttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtcttgtaagagctatacagttttcctaaatgtatacctgtaactgcagcagttcacctatttcaaaaatttggaattctgttcatttgttattcttaagaccacctcaaatttaaaggctaccttattgtacgtttaaagtgtattataacagtgtggtagttaataaaacactatttttttttcttttga

SEQ ID NO: 185113 - DNA, 3627 bp, Homo sapiens
  Payload ID: 16449
  Gene Symbol: SP3
  Gene Name: Sp3 transcription factor
  ENST ID: ENST00000416195
  CDS Start-End: 1-2216
ctcccgaaaagcccgtgaaacaagaggaaatggctgccttggacgtggatagcggcggcggcggtggcggcggcggcggccacggcgagtatctgcagcagcagcaacagcacggaaacggtgcggtggcggcggcagcggcggcccagacaggtgatttggcttctgcacagttaggaggagcaccaaaccgatgggaggttttgtcagccacacctacaactataaaagatgaagctggtaatctagtccagattccaagtgctgctacttcaagtgggcagtatgttcttccccttcagaatttgcagaatcaacaaatattttccgttgcaccaggatcagattcatcaaatggtacagtgtccagtgttcaatatcaagtgataccacagatccagtcagcagatggtcagcaggttcaaattggtttcacaggctcttcagataatgggggtataaatcaagaaagcagtcaaattcagatcattcctggctctaatcaaaccttacttgcctctggaacaccttctgctaacatccagaatctcataccacagactggtcaagtccaggttcagggagttgcaattggtggttcatcttttcctggtcaaacccaagtagttgctaatgtgcctcttggtctgccaggaaatattacgtttgtaccaatcaatagtgtcgatctagattctttgggactctcgggcagttctcagacaatgactgcaggcattaatgccgacggacatttgataaacacaggacaagctatggatagttcagacaattcagaaaggactggtgagcgggtttctcctgatattaatgaaactaatactgatacagatttatttgtgccaacatcctcttcatcacagttgcctgttacgatagatagtacaggtatattacaacaaaacacaaatagcttgactacatctagtgggcaggttcattcttcagatcttcagggaaattatatccagtcgcctgtttctgaagagacacaggcacagaatattcaggtttctacagcacagcctgttgtacagcatctacaacttcaagagtctcagcagccaaccagtcaagcccaaattgtgcaaggtattacaccacagacaatccatggtgtgcaagccagtggtcaaaatatatcacaacaggctttgcaaaatcttcagttgcagctgaatcctggaacctttttaattcaggcacagacagtgaccccttctggacaggtaacttggcaaacgtttcaagtacaaggggtccagaacttgcagaatttgcaaatacagaatactgctgcccaacaaataactttgacgcctgttcaaaccctcacacttggtcaagttgcggcaggtggagccttcacttcaactccagttagtctaagcactggtcagttgccaaatctacaaacagttacagtgaactctatagattctgctggtatacagctacatccaggagagaatgctgacagtcctgcagatattaggatcaaggaagaagaacctgatcctgaagagtggcagctcagtggtgattctaccttgaataccaatgacctaacacacttaagagtacaggtggtagatgaagaaggggaccaacaacatcaagaaggaaaaagacttcggagggtagcttgcacctgtcccaactgtaaagaaggtggtggaagaggtaccaatcttgggaaaaagaagcaacacatttgtcatataccaggatgtggtaaagtctatgggaagacctcacatctgagagctcatctgcgttggcattctggagaacgcccttttgtttgtaactggatgtactgtggtaaaagatttactcgaagtgatgaattacagaggcacagaagaacacatacaggtgagaagaaatttgtttgtccagaatgttcaaaacgctttatgagaagtgaccaccttgccaaacatattaaaacacaccagaataaaaaaggtattcactctagcagtacagtgctggcatctgtggaagctgcgcgagatgatactttgattactgcaggaggaacaacgcttatccttgcaaatattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaatttttggattgacagtaacttggttatacatgacactgaaatgccttactttgtatgatattccatagtatattaaaaatggtaaaattgcatgggttttgtaggtacttttggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaaaaaagtttaaaatgtataagttgaggcatttgggtggtaagagaatgttatagtgaattatcccttttcttgactattggaggaccaaaaaaataaggtgtattgcgtcttagcagtgatttttatccaatcttgtttccaaaaaccatgtctcccagggccttaaaagccatcatgtaaattaccagtaaagtgtaacatatgcaaacataacaaaatcacttccatagtgacgatactccaaccatatggatattagtcatagaagaactagaggttttatgatatttttttaagtcttttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtcttgtaagagctatacagttttcctaaatgtatacctgtaactgcagcagttcacctatttcaaaaatttggaattctgttcatttgttattcttaagaccacctcaaatttaaaggctaccttattgtacgtttaaagtgtattataacagtgtggtagttaataaaacactatttttttttcttttga

SEQ ID NO: 185114 - DNA, 6126 bp, Homo sapiens
  Payload ID: 16450
  Gene Symbol: SP4
  Gene Name: Sp4 transcription factor
  Uniprot ID: Q02446
  ENST ID: ENST00000222584
  CDS Start-End: 219-2573
atcaagggcgagtcagccgggctcgggcggagagaggagctgctacgccacagcccagcggcggccattcgcggaaaaagaggcagagcctgtgccagctacagcctcctccgagccaccgcgggcgggcgggaccggcctctcctcccgcctcgcccccacccccacccacctctatcccagtgtctccgtctgagggtttgtcctgttaatgcgggatgagcgatcagaagaaggaggaggaggaggaggcggcagcggcagcggcgatggctacagaaggagggaaaacctctgagccagagaataacaataaaaaacccaaaacctcaggctcccaggactctcagccctctcctctggctttactggcagctacttgcagcaaaatagggactcctggtgaaaatcaagcaactggacaacaacaaattattatagatccaagtcaaggattggtgcaacttcaaaatcaaccacaacagctagaactggtaacaacgcaacttgctggaaacgcttggcaacttgttgcctccactcctcctgcttcaaaagagaataacgtttctcaaccagcctctagttcgtctagttcttccagcagtaataacgggagtgcatctcctacaaaaactaaatcaggtaattcttccacccctggtcaatttcaagtcatacaagtacaaaatccaagtggtagtgtacagtaccaagtaattccacaacttcagacagtggaaggtcaacaaattcaaatcaatccaactagtagttcatctctacaggatttgcagggtcaaattcagctcatttctgcaggtaataatcaagctatactcacagctgctaacaggacagcttctgggaatattcttgctcaaaacctggcaaatcagacagttccggtccaaattagacctggtgtttcaataccactgcagttacagactcttcctggtactcaggctcaagttgtaacaaccctaccaattaacattggaggagtgactctagctttgccagtgataaacaacgtggctgccggaggagggactgggcaggttggccagcctgctgctactgctgatagtgggacttccaatgggaatcaattagtttccacacccaccaacaccactacttctgccagtactatgccagaatctccctcctcctccactacctgcacaaccactgcttcaacgtctttgacaagcagtgacacattagtgagctcagcagatactggccagtatgcaagcacatcagccagtagttctgaacgcaccattgaagaatctcaaacacctgctgctactgagtctgaagcccagagctccagtcagcttcagcctaatggaatgcagaatgcacaggatcaatcaaattctcttcagcaggtgcaaattgtaggccaacctatcttacagcagatccagatccaacagcctcagcaacagatcattcaggctattccaccacagtcgtttcaactccagtcagggcagacgattcagaccatccagcagcagcctttacagaatgttcaacttcaagcagtaaatccgactcaggtgcttatcagggctccaactttaacaccttcagggcaaatcagttggcaaactgtacaggttcagaatattcagagtctttcaaatttgcaagttcagaatgctgggttatcccaacaattaaccatcaccccagtgtcttcaagtggtggcacaactcttgctcagattgctcctgtggctgttgctggtgccccaataactttgaatactgcccagcttgcatcagtgcctaaccttcagacagtgagcgttgccaacctgggtgctgcaggtgttcaagtgcagggagttcccgttacaatcactagtgttgcaggtcagcagcaaggacaagatggagtaaaagtccagcaagctactatagctcctgtaactgtagcagttggaggaattgctaatgccacgataggtgctgttagtcctgaccaactcacacaagtgcatttgcagcaaggccagcagacttctgatcaagaggtacaacctggcaagaggcttcgaagagttgcctgttcctgtcctaattgtagggaaggagaaggaagaggcagtaatgaaccaggaaaaaagaagcagcatatctgtcatattgaaggatgtggtaaagtttatggcaaaacatctcatttacgagcacatcttcgctggcatactggagaaagaccttttatatgcaactggatgttttgtggcaaaagattcacacggagtgatgagctccagagacatagaagaacccatacaggtgaaaagagatttgaatgcccggaatgttctaaaaggtttatgcggagtgatcatctctccaaacatgtcaaaacgcaccagaataaaaaaggtggtgggacagctcttgccattgttacctcgggagaactggactcatctgttacagaggtgcttggctccccaagaattgtcacagttgcagccatttctcaagattcgaatccagcaactcccaatgtttcaaccaacatggaagaattctgaaaagttatttataacagagacctctagtgctgcacttgtttacacacctttgaaaatctggaaatgggctggtcaagtggattacagagtaggaaattatgttttcattcttggcttctttaagtattccagggtttggggtcaacacgtgaagtgttgaattttaaaaaatacaaaaagcagactgatgtactggaaacagaaaagtatttcctccatactataagttgtagttgtttggaaatatatcacataacctttatacagaatcttcccatctcttaatatcatgtgttaacatgtttaaaaagaccttagtagtttgcaggctggaccttaattggacttattttctttgaaagtactttgttataaattcagtcagtaataatttacgtgtattctttttctctatagcacagaaaacagatagttaactgatgatagggataatactgtatttccttagcttgatttttggaaaatcaaccgaaaatagtttggccgtcttttctaaatgttagaaattcttcaacagttgaattaggtaagttccaaaacagtaatctgagatgcatctcagatctttattaccactacattatagtagtgtgtatgcagacaatcagtgaagtccaattactttctccatttggagacacaagaggaacatagagttaaatcttaggttaaattttaggttgacaccttaggaaaatgctgggaaaaaaatggttaaaacaaaactcatcatagcttcagaaaaataaaatgaggcatcttaacatgcaatgttctaaagttaggattgattatattcctaaccctaggttgaaccacaaaatttcatttaaaatgtttatatttggaaatatttgcatagagtgtaaattgttctgtagtttcatattttgtaaatatgagttatgttgacaatgtgcagaattctttatgctttgatgtggtagccaaagaaagaattacacttttttccaaggccagcagaaaattctcttttaactacattgtaattcttgttttcctctactaaaaattggccagtcccattttatttctagtgctatgtaagaaggtaattaggaattataacacagtaatgtttttatgttacatcaataactgaattttccctaaaaattagcctaatatataatagatatattatgaagcaaaacttttatttttgaaaaggcagaataattttcagtgaagtaagtgactaaagaaaaaaactatattattgtttatgcaagggtcttacaggaaagggtctttttttttttttttttgagatggagtctcgctctcttgcccaggctggagtgcaatggcacgatctcagcttactgcaaccgccgcctcccaggttcaagcgattctcctgtcttagcctcctgagtagctgggattaacaggcgcctgccaccatgcctggctaatttttgtatttttagtagagacagggtttcgccatgttggccaggctggtttcaaactcctgacctcaggtgatctgcccacctcggcctcccagagtgctgggattacaggcatgagccaccatgcccggctaggaaagggtcttactaggaaagatggccaaaagtttcatatgaaaaaaattggattataaaccagtaacttaaatattaataaggatattttatgttttaaaaaagtatttacacagaatcataatcagtgaaattgaccatttgaaaactaaaagtttttacctacctgctcaatttattaacatcattgctttggggactgtttgaatataggtacgtgttttcttgtgcattctctataatttcaggaaaagtactaatgcgaattctcttccaaaattgtgatgtttcttgtatttttgatgaaggagaaatactgtaatgatcactgtttacactatgtacactttaggccagccctttgtagcgttatataaaactgaaggtcttttgtgctttcagtttgtataaaaaagctttgagattaaaggaaaaaaaaaatttttacactgtggttataaatttcaagtttcttaaagcttttgtagacttgtaacagagtctttaaatttaagttggattttgtaaattgttttgtatattttatttaatgtactcttaacaactgatgtatctggctttaaaacatcagaattggtttgttgttttgtttggtacagaggagcatttggtagtgttcattttaattttattatataggagctgaaacatcaaatatatattttatctatcattatgctacacaatcagtgctataaatttttttatgcaaagaaactttcttaatgttttaatcatgtttcctcagagtgacactttttgttgttgttaataccaagtatgaacactctgcatcattattccatgaaccagttctaatgcaaacctatgtatgtccattagaaatggaagttattttttaatcaacaatgaggcctattataaatttatcagatgaatctagatagctttatagcatataaaatatgttaatttgtgttagcaggtgcacatttcaccactgaaattagaaatattttgacagtctgttctgcataccattctgagtctacttttctgtctttagaagaatcgtaaatttcagtgtcctttatttgactcagtgggatatagctgttataagtaatagggcacagatgtgcagtagagtcttgtttaatggcatttcactgttcattccctttaccaccgttataaaacttttctttattgtaattatcagtgcaaagctatgtatttatcatggtaaaactccagtgttagaatagttttttcttacagtatactttctttggttaggtttgtgtatgtgttgctgattacattagaacttgatgttaagtcatttatcacactctcatgagagcagtaataaaagtgtgtaatctaggagaaaaagttaatttgtcaaacttagataagcatgatgtttaggtcctatttttcaattttataactgttttattgcaacaatatttgtatttaagtctccattttaatgccttgtggtgtttttttatgcatgtcactaagttgtcatcccacataaattgatgtgcagcatagggtattaaatctacataatgattttaaaacagaaatagttgatggtaaaatgtaaatgttttgcaaaaattccttataaaaagttttgtagtaacatttcacttgtaaattttttttgtaaaaaaaaaaaaatgaaaaaaaaagatgaatccagaaaaaaacctgtttcccatattctagaatttagacaattattctgccagcaaagcctctggggctgtaattgacatttttacagtgctgatttgtataaaatttgttttttgtggatttggaaataaaatcatgtacaagttgttgcctgcaataacaattgcaagtaacctattaaaaattcccttgagtttaacatgtttcatttaattatgtatactataaagcagcaataaattatttgaactatcaaccta

SEQ ID NO: 185115 - DNA, 4293 bp, Homo sapiens
  Payload ID: 16450
  Gene Symbol: SP4
  Gene Name: Sp4 transcription factor
  ENST ID: ENST00000448246
  CDS Start-End: 209-358
agtcagccgggctcgggcggagagaggagctgctacgccacagcccagcggcggccattcgcggaaaaagaggcagagcctgtgccagctacagcctcctccgagccaccgcgggcgggcgggaccggcctctcctcccgcctcgcccccacccccacccacctctatcccagtgtctccgtctgagggtttgtcctgttaatgcgggatgagcgatcagaagaaggaggaggaggaggaggcggcagcggcagcggcgatggctacagaaggagggaaaacctctgagccagagaataacaataaaaaacccaaaacctcaggctcccaggtcagcagcaaggacaagatggagtaaaagtccagcaagctactatagctcctgtaactgtagcagttggaggaattgctaatgccacgataggtgctgttagtcctgaccaactcacacaagtgcatttgcagcaaggccagcagacttctgatcaagaggtacaacctggcaagaggcttcgaagagttgcctgttcctgtcctaattgtagggaaggagaaggaagaggcagtaatgaaccaggaaaaaagaagcagcatatctgtcatattgaaggatgtggtaaagtttatggcaaaacatctcatttacgagcacatcttcgctggcatactggagaaagaccttttatatgcaactggatgttttgtggcaaaagattcacacggagtgatgagctccagagacatagaagaacccatacaggtgaaaagagatttgaatgcccggaatgttctaaaaggtttatgcggagtgatcatctctccaaacatgtcaaaacgcaccagaataaaaaaggtggtgggacagctcttgccattgttacctcgggagaactggactcatctgttacagaggtgcttggctccccaagaattgtcacagttgcagccatttctcaagattcgaatccagcaactcccaatgtttcaaccaacatggaagaattctgaaaagttatttataacagagacctctagtgctgcacttgtttacacacctttgaaaatctggaaatgggctggtcaagtggattacagagtaggaaattatgttttcattcttggcttctttaagtattccagggtttggggtcaacacgtgaagtgttgaattttaaaaaatacaaaaagcagactgatgtactggaaacagaaaagtatttcctccatactataagttgtagttgtttggaaatatatcacataacctttatacagaatcttcccatctcttaatatcatgtgttaacatgtttaaaaagaccttagtagtttgcaggctggaccttaattggacttattttctttgaaagtactttgttataaattcagtcagtaataatttacgtgtattctttttctctatagcacagaaaacagatagttaactgatgatagggataatactgtatttccttagcttgatttttggaaaatcaaccgaaaatagtttggccgtcttttctaaatgttagaaattcttcaacagttgaattaggtaagttccaaaacagtaatctgagatgcatctcagatctttattaccactacattatagtagtgtgtatgcagacaatcagtgaagtccaattactttctccatttggagacacaagaggaacatagagttaaatcttaggttaaattttaggttgacaccttaggaaaatgctgggaaaaaaatggttaaaacaaaactcatcatagcttcagaaaaataaaatgaggcatcttaacatgcaatgttctaaagttaggattgattatattcctaaccctaggttgaaccacaaaatttcatttaaaatgtttatatttggaaatatttgcatagagtgtaaattgttctgtagtttcatattttgtaaatatgagttatgttgacaatgtgcagaattctttatgctttgatgtggtagccaaagaaagaattacacttttttccaaggccagcagaaaattctcttttaactacattgtaattcttgttttcctctactaaaaattggccagtcccattttatttctagtgctatgtaagaaggtaattaggaattataacacagtaatgtttttatgttacatcaataactgaattttccctaaaaattagcctaatatataatagatatattatgaagcaaaacttttatttttgaaaaggcagaataattttcagtgaagtaagtgactaaagaaaaaaactatattattgtttatgcaagggtcttacaggaaagggtctttttttttttttttttgagatggagtctcgctctcttgcccaggctggagtgcaatggcacgatctcagcttactgcaaccgccgcctcccaggttcaagcgattctcctgtcttagcctcctgagtagctgggattaacaggcgcctgccaccatgcctggctaatttttgtatttttagtagagacagggtttcgccatgttggccaggctggtttcaaactcctgacctcaggtgatctgcccacctcggcctcccagagtgctgggattacaggcatgagccaccatgcccggctaggaaagggtcttactaggaaagatggccaaaagtttcatatgaaaaaaattggattataaaccagtaacttaaatattaataaggatattttatgttttaaaaaagtatttacacagaatcataatcagtgaaattgaccatttgaaaactaaaagtttttacctacctgctcaatttattaacatcattgctttggggactgtttgaatataggtacgtgttttcttgtgcattctctataatttcaggaaaagtactaatgcgaattctcttccaaaattgtgatgtttcttgtatttttgatgaaggagaaatactgtaatgatcactgtttacactatgtacactttaggccagccctttgtagcgttatataaaactgaaggtcttttgtgctttcagtttgtataaaaaagctttgagattaaaggaaaaaaaaaatttttacactgtggttataaatttcaagtttcttaaagcttttgtagacttgtaacagagtctttaaatttaagttggattttgtaaattgttttgtatattttatttaatgtactcttaacaactgatgtatctggctttaaaacatcagaattggtttgttgttttgtttggtacagaggagcatttggtagtgttcattttaattttattatataggagctgaaacatcaaatatatattttatctatcattatgctacacaatcagtgctataaatttttttatgcaaagaaactttcttaatgttttaatcatgtttcctcagagtgacactttttgttgttgttaataccaagtatgaacactctgcatcattattccatgaaccagttctaatgcaaacctatgtatgtccattagaaatggaagttattttttaatcaacaatgaggcctattataaatttatcagatgaatctagatagctttatagcatataaaatatgttaatttgtgttagcaggtgcacatttcaccactgaaattagaaatattttgacagtctgttctgcataccattctgagtctacttttctgtctttagaagaatcgtaaatttcagtgtcctttatttgactcagtgggatatagctgttataagtaatagggcacagatgtgcagtagagtcttgtttaatggcatttcactgttcattccctttaccaccgttataaaacttttctttattgtaattatcagtgcaaagctatgtatttatcatggtaaaactccagtgttagaatagttttttcttacagtatactttctttggttaggtttgtgtatgtgttgctgattacattagaacttgatgttaagtcatttatcacactctcatgagagcagtaataaaagtgtgtaatctaggagaaaaagttaatttgtcaaacttagataagcatgatgtttaggtcctatttttcaattttataactgttttattgcaacaatatttgtatttaagtctccattttaatgccttgtggtgtttttttatgcatgtcactaagttgtcatcccacataaattgatgtgcagcatagggtattaaatctacataatgattttaaaacagaaatagttgatggtaaaatgtaaatgttttgcaaaaattccttataaaaagttttgtagtaacatttcacttgtaaattttttttgtaaaaaaaaaaaaatgaaaaaaaa

SEQ ID NO: 185116 - DNA, 377 bp, Homo sapiens
  Payload ID: 16450
  Gene Symbol: SP4
  Gene Name: Sp4 transcription factor
  ENST ID: ENST00000432066
  CDS Start-End: 210-377
gagtcagccgggctcgggcggagagaggagctgctacgccacagcccagcggcggccattcgcggaaaaagaggcagagcctgtgccagctacagcctcctccgagccaccgcgggcgggcgggaccggcctctcctcccgcctcgcccccacccccacccacctctatcccagtgtctccgtctgagggtttgtcctgttaatgcgggatgagcggtcagcagcaaggacaagatggagtaaaagtccagcaagctactatagctcctgtaactgtagcagttggaggaattgctaatgccacgataggtgctgttagtcctgaccaactcacacaagtgcatttgcagcaaggccagcagacttctgatcaagag

SEQ ID NO: 185117 - DNA, 2033 bp, Homo sapiens
  Payload ID: 16451
  Gene Symbol: SP5
  Gene Name: Sp5 transcription factor
  Uniprot ID: Q6BEB4
  ENST ID: ENST00000375281
  CDS Start-End: 163-1359
gcgagcgagcggggcgcggcgaggggcaagggcggggagggccccggcgctcagagcaggcgccagggaggcaggctgggcggcccttcgtcctcgccttcgggtgtccatgcctcggcggcggcgtcccgctccgcagccaggggcctgcaagccgtagccatggccgcggtggccgtcctccggaacgactcgctgcaggcctttctccaggaccgcacccccagcgcctccccggacctgggcaagcactcgcccctggcattgctggccgccacctgtagccgcatcggccagccgggcgcggcggcgcccccggacttcctgcaggtgccctacgaccccgcgctgggctcaccctccaggctcttccacccgtggaccgccgacatgccggcgcactcgccaggcgcactgccgcccccgcatcccagcttggggctgacgccgcagaagacgcacctgcagccgtccttcggggctgcgcacgagcttccccttacaccccccgccgacccctcgtacccctacgagttctcgccggtcaagatgctgccctcgagcatggcggctctgcccgccagctgcgcgcccgcctacgtgccctacgcggcgcaggccgcgctgccgccaggctactccaacctgctgcctccgccgccgccaccgcccccgccgcccacctgccgccagttgtcacccaacccggcccccgacgacctcccgtggtggagcatcccgcaggcgggcgccgggccgggggcctccggggttccgggaagcggcctctccggcgcctgtgccggggccccccacgcgccccgcttccccgcctctgcggccgctgctgctgcggccgccgccgccctacaaagaggcctggtgttgggcccgtcggactttgcgcagtaccagagccagatcgccgcgctgctgcagaccaaggcccccctggcggccacggccaggaggtgccgccgctgccgctgtcccaactgccaggcggcgggcggcgcccccgaggcggagccggggaagaagaagcagcacgtgtgccacgtgccgggctgcggcaaggtgtacgggaagacgtcgcacctgaaggcgcacctgcgctggcacacgggcgagcgacccttcgtgtgcaactggctcttctgcgggaagagcttcacgcgctcggacgagctgcagcggcacctgcggactcacacgggcgagaagcgctttgcctgtcccgagtgcggcaagcgcttcatgcgcagcgaccacctcgcgaagcacgtcaagactcaccagaataagaagctcaaagtcgctgaggccggggttaagcgggaggacgcgcgggacctgtgagccctcccggaggtggacccccttcccagcacctctgcgagagatccggggacctgtgggcagctggcggaggggagactcagcagacggaccctctccgttgcctgcctcccaaaatggagccaggcttccaacttccgctgccttcggacatagggacccagttcccaggagcggggaggtagggttggggctggggcatttggattgtaattgggagctctgccgtacgccagggcggttccaaactctaaaccgttcccaccgtcagggagacctacagtttcgggggaccaccctggtctggccttgtatataggaaatgctgctgaactgaatagaaaggaacttgggagatttgaaacagtgctcgggttttcgctaggaccggtttgggctttgtacaggttatttaatagctttgttaaagataattataataattataacattaataaaaatgttgcttttgtcttcagctccatgcagagctacagcatgatatgtctctgtaaagtgatcagcagttgcagcgtgaaaataaatactttaactcaggggtcactacaggaagaccccgttgagccggtctcatttgatcttttcttcttctgggtggctgtactaagcggtcgggtttccccgggaatttgatggttcctatagtctgcctg

SEQ ID NO: 185118 - DNA, 3800 bp, Homo sapiens
  Payload ID: 16452
  Gene Symbol: SP6
  Gene Name: Sp6 transcription factor
  Uniprot ID: Q3SY56
  ENST ID: ENST00000342234
  CDS Start-End: 279-1409
gactcagatctcacctcctaccactcccctaggagagctgggggccactgtttcctggattatcctaaaagcttctgaggccgtgaggacttggcagcatccctgctccctccttcacctccccctttggcactgcctgtcacctcctttataaagcctggctcttttatcaccgccacttggccctcactgccgccgccagctctgggctccatggactggtcccgtctgaggtgcccctgaccgtccctgccctcaccccaccccggatcccggcaatgctaaccgctgtctgcggctctctgggcagccagcacacggaagcgccgcacgcctccccgccgcgcctcgacctgcagcctctccaaacttaccagggccacacgagccctgaggccggggactacccctccccgctgcagcctggagagctgcagagcctcccgctgggcccggaggtggacttctcgcagggctatgagctgccaggggcctcctcgcgggtaacctgcgaggacctggaaagcgacagtcccttggccccgggccccttttccaagctcctgcagccggacatgtcacaccattatgaatcgtggttcaggccgactcacccaggcgcggaggatggctcgtggtgggaccttcatccgggcaccagctggatggacctcccccacactcagggcgcgctgacctcacctggccacccgggggcgcttcaggcgggcttggggggctacgtcggagaccaccagctttgtgccccgccaccccacccgcatgcgcaccacctccttccagctgccggagggcagcatctcctagggccgcccgacggggctaaggccttggaagtagccgccccggagtctcaagggctggattccagcctggacggggcggcgcgtcccaaaggctcccggcggtcggtgccccgcagctcaggccagaccgtctgtcgctgccccaactgtctggaggcggagcgactgggggctccatgtgggcccgatgggggcaagaagaagcatttgcacaactgccacatcccgggctgcgggaaagcctacgccaagacgtcgcacctgaaggcgcacctgcgctggcacagcggcgaccgtcccttcgtgtgcaactggctcttctgcggcaagcgcttcacgcgctcggacgagctgcagcgccacctccagacccacaccggcaccaagaagttcccctgtgcagtctgcagccgcgtcttcatgcgcagcgaccacctggccaagcacatgaaaacccacgagggcgccaaggaggaggcggctggggcggcctcgggagagggcaaggccggcggcgcagtggagccccccgggggcaaaggcaaacgcgaggccgagggcagcgtggctccctccaactgagctcctcagtgccgcctccctgcgggtatcccggggggcactggatgcgagcccccaggtctgacgtccttgggggtggcttgaggaagaggggaaggtgcgtatttattcagggaggaggaaaagtggtgcagggacagggagatggggcgctaggggttcttagtctctggggctactaggcaggatgaatttgactgggtcggtaggagctgcgcaatgcccctctgttctcccctgcctcacagtttccctcgcccctgggctggggggttggggtgggacacccgtaccgcggctggctggcggggacaggctagaggagacagcaagtcccagtccccggagcagagagaagtggggccggcccggggcgctggtggtggctgtctggacacgtccttagcgcctgggaaccaggacataaaagcgcctccggagccgccctgcggcggggtccctttcatcccacttaaagtgcttctgcccctagggtttccggagggagagccgagatgggatgggggagcctgggggtcccccttggcaggggtgtctctttctggtttggagggttgttgctgtaaaaataactcctttgatgagcttccttattaaccctttcagacccagtctgttggagccatgaaggaagagggaaagagggctgccattcctgacagcctcccagccagggctggcgataaaggaccgagatagatggagggggcgagtagggaagtcctcttctaaaatgagagatagggatttggtggggtatggaaggaactaaccccttccctctccacctctgattcagcccttaattcttggtctatgataaataaagttcagtagtctcacattccccatctattaccctaggtgtgttttcaaggcagccagcggtagaatccatgtagttcccaccagttgccttcccctcagggatggaaggaagagggtttcttgggctggttgagggcagattgggggtgtctcatcagagggacctccactggttcccactcagagtggaggcctgcagcctacctgaccatctctttagctgtcaccaagaaaataaaccccactgtctctctagcttggcccttgtctttcccttgcccctgccatagcatgttcattaggggattccttcctccccctcatctcacaggggaagggagaggaaagagttgttctcccactggaaggggttctgccttctgaggtgacatccaggaagctgtccccattcccttctcctttagatgctagaaacacattttgattctgatcatggggtgggggagagaggaaaggagggaggggagaagcccagcagaagctgagccaggcagaggggaaagaagctgatatgaggaagggtctgacaggccacagcccttgcagccggagggctttcccacactcaagagaggggccttacagtccctctgacacccctcccccttcccctcgctccctttcttcacccggagccctctgcagagattagctgtgtattgatttttaagttataagcaaagggtattttatttaatattaggttatgtgtgtgcatgttgtgtgtacctgtgtgcatgtatgtgtgtttctctactgagcctggggtctctagccagggagaccccatcttattcaccatgtccaagatcctgggatctgggcccagcatctcttcctcctttgtagatgctggagcccagccaaggtctgggagctatatgggaagtgggggctgggatctgggtgggaatatgtgtttgtatacaaaggggccctccttaaaagggacaggatgaccttcccgaggaactcattggcctggggtagtttaagaagtaatgttctttctttctttctcttttccctacctcctgctaacccaaccagagatccccttccttgctgagagggttgggggcaggaggagatttggcagtgcctgcaggttgcctggccaggtggagagggggaaagaggaagggcaccgtgggtgtaagatgcctttctcctccacccatcgaaaccagccaccccttccctgtgccaccaagacagccttttccagtggccatcctaaggggaactcccaaatgggtgttgctggtggacacagatgctccccccaatggaagccccaagctctgaggtatgcgggtagaggctttggataggttttcttctgctcccctcttttatagatctaggctgcttggctgcctgtctttctaggcagtccccctagaggaaaaatgtaggaatttattttttctttaactgctgtgaactcactttgagggggtaggaggagggagaaacagcctgtgttttttatgcaataaagtcatcaactacatcatg

SEQ ID NO: 185119 - DNA, 3848 bp, Homo sapiens
  Payload ID: 16452
  Gene Symbol: SP6
  Gene Name: Sp6 transcription factor
  Uniprot ID: Q3SY56
  ENST ID: ENST00000536300
  CDS Start-End: 333-1463
aaaaagcagcgctggggagaggatgaaggcagagagcgcgggtgagtcacgggcggagctggccttgttcgctcgctggctcctgcccgccctccgtcctccgccctctcgccagcgctcacctccgccgcctgccgcctgccgccagccgccgggtctggctcgccctgggctcctgccccttaccgctggagagctcgccggcgcacagggcctatgagcgaccgtcagtagcgcaccagccagccgtgcccggagcccgccgcagcctcgaggtcccgtctgaggtgcccctgaccgtccctgccctcaccccaccccggatcccggcaatgctaaccgctgtctgcggctctctgggcagccagcacacggaagcgccgcacgcctccccgccgcgcctcgacctgcagcctctccaaacttaccagggccacacgagccctgaggccggggactacccctccccgctgcagcctggagagctgcagagcctcccgctgggcccggaggtggacttctcgcagggctatgagctgccaggggcctcctcgcgggtaacctgcgaggacctggaaagcgacagtcccttggccccgggccccttttccaagctcctgcagccggacatgtcacaccattatgaatcgtggttcaggccgactcacccaggcgcggaggatggctcgtggtgggaccttcatccgggcaccagctggatggacctcccccacactcagggcgcgctgacctcacctggccacccgggggcgcttcaggcgggcttggggggctacgtcggagaccaccagctttgtgccccgccaccccacccgcatgcgcaccacctccttccagctgccggagggcagcatctcctagggccgcccgacggggctaaggccttggaagtagccgccccggagtctcaagggctggattccagcctggacggggcggcgcgtcccaaaggctcccggcggtcggtgccccgcagctcaggccagaccgtctgtcgctgccccaactgtctggaggcggagcgactgggggctccatgtgggcccgatgggggcaagaagaagcatttgcacaactgccacatcccgggctgcgggaaagcctacgccaagacgtcgcacctgaaggcgcacctgcgctggcacagcggcgaccgtcccttcgtgtgcaactggctcttctgcggcaagcgcttcacgcgctcggacgagctgcagcgccacctccagacccacaccggcaccaagaagttcccctgtgcagtctgcagccgcgtcttcatgcgcagcgaccacctggccaagcacatgaaaacccacgagggcgccaaggaggaggcggctggggcggcctcgggagagggcaaggccggcggcgcagtggagccccccgggggcaaaggcaaacgcgaggccgagggcagcgtggctccctccaactgagctcctcagtgccgcctccctgcgggtatcccggggggcactggatgcgagcccccaggtctgacgtccttgggggtggcttgaggaagaggggaaggtgcgtatttattcagggaggaggaaaagtggtgcagggacagggagatggggcgctaggggttcttagtctctggggctactaggcaggatgaatttgactgggtcggtaggagctgcgcaatgcccctctgttctcccctgcctcacagtttccctcgcccctgggctggggggttggggtgggacacccgtaccgcggctggctggcggggacaggctagaggagacagcaagtcccagtccccggagcagagagaagtggggccggcccggggcgctggtggtggctgtctggacacgtccttagcgcctgggaaccaggacataaaagcgcctccggagccgccctgcggcggggtccctttcatcccacttaaagtgcttctgcccctagggtttccggagggagagccgagatgggatgggggagcctgggggtcccccttggcaggggtgtctctttctggtttggagggttgttgctgtaaaaataactcctttgatgagcttccttattaaccctttcagacccagtctgttggagccatgaaggaagagggaaagagggctgccattcctgacagcctcccagccagggctggcgataaaggaccgagatagatggagggggcgagtagggaagtcctcttctaaaatgagagatagggatttggtggggtatggaaggaactaaccccttccctctccacctctgattcagcccttaattcttggtctatgataaataaagttcagtagtctcacattccccatctattaccctaggtgtgttttcaaggcagccagcggtagaatccatgtagttcccaccagttgccttcccctcagggatggaaggaagagggtttcttgggctggttgagggcagattgggggtgtctcatcagagggacctccactggttcccactcagagtggaggcctgcagcctacctgaccatctctttagctgtcaccaagaaaataaaccccactgtctctctagcttggcccttgtctttcccttgcccctgccatagcatgttcattaggggattccttcctccccctcatctcacaggggaagggagaggaaagagttgttctcccactggaaggggttctgccttctgaggtgacatccaggaagctgtccccattcccttctcctttagatgctagaaacacattttgattctgatcatggggtgggggagagaggaaaggagggaggggagaagcccagcagaagctgagccaggcagaggggaaagaagctgatatgaggaagggtctgacaggccacagcccttgcagccggagggctttcccacactcaagagaggggccttacagtccctctgacacccctcccccttcccctcgctccctttcttcacccggagccctctgcagagattagctgtgtattgatttttaagttataagcaaagggtattttatttaatattaggttatgtgtgtgcatgttgtgtgtacctgtgtgcatgtatgtgtgtttctctactgagcctggggtctctagccagggagaccccatcttattcaccatgtccaagatcctgggatctgggcccagcatctcttcctcctttgtagatgctggagcccagccaaggtctgggagctatatgggaagtgggggctgggatctgggtgggaatatgtgtttgtatacaaaggggccctccttaaaagggacaggatgaccttcccgaggaactcattggcctggggtagtttaagaagtaatgttctttctttctttctcttttccctacctcctgctaacccaaccagagatccccttccttgctgagagggttgggggcaggaggagatttggcagtgcctgcaggttgcctggccaggtggagagggggaaagaggaagggcaccgtgggtgtaagatgcctttctcctccacccatcgaaaccagccaccccttccctgtgccaccaagacagccttttccagtggccatcctaaggggaactcccaaatgggtgttgctggtggacacagatgctccccccaatggaagccccaagctctgaggtatgcgggtagaggctttggataggttttcttctgctcccctcttttatagatctaggctgcttggctgcctgtctttctaggcagtccccctagaggaaaaatgtaggaatttattttttctttaactgctgtgaactcactttgagggggtaggaggagggagaaacagcctgtgttttttatgcaataaagtcatcaactac

SEQ ID NO: 185120 - DNA, 2971 bp, Homo sapiens
  Payload ID: 16453
  Gene Symbol: SP7
  Gene Name: Sp7 transcription factor
  Uniprot ID: Q8TDD2
  ENST ID: ENST00000303846
  CDS Start-End: 109-1404
attctcccattctccctccctctcccttttctctctctaccccccccaccccccggctcagctctctccatctgcctggctccttgggacccgttccccagcctcaggatggcgtcctccctgcttgaggaggaagttcactatggctccagtcccctggccatgctgacggcagcgtgcagcaaatttggtggctctagccctctgcgggactcaacaactctgggcaaagcaggcacaaagaagccgtactctgtgggcagtgacctttcagcctccaaaaccatgggggatgcttatccagccccctttacaagcactaatgggctcctttcacctgcaggcagtcctccagcacccacctcaggctatgctaatgattaccctcccttttcccactcattccctgggcccacaggcacccaggaccctgggctactagtgcccaaggggcacagctcttctgactgtctgcccagtgtctacacctctctggacatgacacacccctatggctcctggtacaaggcaggcatccatgcaggcatttcaccaggcccaggcaacactcctactccatggtgggatatgcaccctggaggcaactggctaggtggtgggcagggccagggtgatgggctgcaagggacactgcccacaggtccagctcagcctccactgaacccccagctgcccacctacccatctgactttgctccccttaatccagccccctacccagctccccacctcttgcaaccagggccccagcatgtcttgccccaagatgtctataaacccaaggcagtgggaaatagtgggcagctagaagggagtggtggagccaaacccccacggggtgcaagcactgggggtagtggtggatatgggggcagtggggcagggcgctcctcctgcgactgccctaattgccaggagctagagcggctgggagcagcagcggctgggctgcggaagaagcccatccacagctgccacatccctggctgcggcaaggtgtatggcaaggcttcgcacctgaaggcccacttgcgctggcacacaggcgagaggcccttcgtctgcaactggctcttctgcggcaagaggttcactcgttcggatgagctggagcgtcatgtgcgcactcacacccgggagaagaagttcacctgcctgctctgctccaagcgctttacccgaagcgaccacctgagcaaacaccagcgcacccatggagaaccaggcccgggtccccctcccagtggccccaaggagctgggggagggccgcagcacgggggaagaggaggccagtcagacgccccgaccttctgcctcgccagcaaccccagagaaagcccctggaggcagccctgagcagagcaacttgctggagatctgagccgggtggaaggtctcccaccccagggctgccctgacagtctctcttggctctctagaccactgcttgccaatcactctctttaccccatgcatgccatccttcggggctctctccctctgtctccctcctggccattctgggcttgggtatctccttgcatgcctcctcagctcaccttctctcttcaccatgagactggctttccacaaactctcatctcaggccctccccttgtgcctgatacctgcactccggcttcctagactctggccctgccacaccaacacactttctatttgggctcccaacactatttctccatctcactccttgacatgtacccctttctgcttctcaagcttatttcctgctgtccctcagcctccaggcttcagtcttcccaacttcttacaccattgctttccattctccagaactcttttttcctttttacaaacacaatgataatgataatttattgccccctggtggcctcttcatcaggggtattggggttagtgacctggccagagggtgccaagaggggggcagaccagtggggatctgatcccaaagatggggtgaccccagggtcagggaggctgcccccaggcctgtatatttaacccctatgtaccaggagtaatgaatagtaataattctatttatgtaagttatgatgacgggtcaggtagagtgagctggggagggaagtggatccatttctgctaaggaaattctagtcaaatgcatctctgtatagacaaaatgttagtggagaagatcttgttaatagaatgtctatcatcagaatctcagttgatagggtttctcttgtaatgaagtctctacaaattgggttagctacatctctgctaaacagttgatggggtatctcttgattagggggatccctaatatccccagccccagccagaagctgtgaaacctcaagtcctatggaggggagaaggactggaatgtaccccatctcccttgactgcagagcaggttcctccactgccccaccccttagacaccatgaccccatcaggttaatcccctgttgccatggttatggagagcttgcagctgccatcttagatgtgctctttggggaagcccatctaacaggaggacattggtttgggggtgcacctcctgaagaatgggtggggaaggctttctctaggatcagattcaaataagtatgtattgagtgcctactctgtgcaaggcactatgctagatctggtgcctagaagccctgagaaagaacttaaagagctaggaggacagaggcccccaagctgatctggtggtgcatccacgcacccccaccctgggactttggatgctcccatctccacctccagtgacttttaaagccgcttcgtgcctttcctgtaacgttggatcctccttttctgtcccctgctgtctcaaggccccaagttaaagggttaaagccgctggagcttggggagagaacattgtggaatggaagggatcatgccctttgtggagtcttttttttttaatttaataaataaaagttggattt

SEQ ID NO: 185121 - DNA, 1472 bp, Homo sapiens
  Payload ID: 16453
  Gene Symbol: SP7
  Gene Name: Sp7 transcription factor
  Uniprot ID: Q8TDD2
  ENST ID: ENST00000537210
  CDS Start-End: 231-1472
agcagccgccgagcagcagcaaggactctggagtcagagtaggactgtaggaccggagcctgagtggaacaggagtggagctggcctgggagagagcggatccctcccagcaccctcaggccacccgttgcctgcactctccctgccagacctccagagaggagagactcgggacagccagccccaggttcccccaggaggaagttcactatggctccagtcccctggccatgctgacggcagcgtgcagcaaatttggtggctctagccctctgcgggactcaacaactctgggcaaagcaggcacaaagaagccgtactctgtgggcagtgacctttcagcctccaaaaccatgggggatgcttatccagccccctttacaagcactaatgggctcctttcacctgcaggcagtcctccagcacccacctcaggctatgctaatgattaccctcccttttcccactcattccctgggcccacaggcacccaggaccctgggctactagtgcccaaggggcacagctcttctgactgtctgcccagtgtctacacctctctggacatgacacacccctatggctcctggtacaaggcaggcatccatgcaggcatttcaccaggcccaggcaacactcctactccatggtgggatatgcaccctggaggcaactggctaggtggtgggcagggccagggtgatgggctgcaagggacactgcccacaggtccagctcagcctccactgaacccccagctgcccacctacccatctgactttgctccccttaatccagccccctacccagctccccacctcttgcaaccagggccccagcatgtcttgccccaagatgtctataaacccaaggcagtgggaaatagtgggcagctagaagggagtggtggagccaaacccccacggggtgcaagcactgggggtagtggtggatatgggggcagtggggcagggcgctcctcctgcgactgccctaattgccaggagctagagcggctgggagcagcagcggctgggctgcggaagaagcccatccacagctgccacatccctggctgcggcaaggtgtatggcaaggcttcgcacctgaaggcccacttgcgctggcacacaggcgagaggcccttcgtctgcaactggctcttctgcggcaagaggttcactcgttcggatgagctggagcgtcatgtgcgcactcacacccgggagaagaagttcacctgcctgctctgctccaagcgctttacccgaagcgaccacctgagcaaacaccagcgcacccatggagaaccaggcccgggtccccctcccagtggccccaaggagctgggggagggccgcagcacgggggaagaggaggccagtcagacgccccgaccttctgcctcgccagcaaccccagagaaagcccctggaggcagccctgagcagagcaacttgctggagatctga

SEQ ID NO: 185122 - DNA, 3151 bp, Homo sapiens
  Payload ID: 16453
  Gene Symbol: SP7
  Gene Name: Sp7 transcription factor
  Uniprot ID: Q8TDD2
  ENST ID: ENST00000536324
  CDS Start-End: 285-1580
ggcgggcggcagcagcctaggcagcagcagtagcagaagcagcagccgccgagcagcagcaaggactctggagtcagagtaggactgtaggaccggagcctgagtggaacaggagtggagctggcctgggagagagcggatccctcccagcaccctcaggccacccgttgcctgcactctccctgccagacctccagagaggagagactcgggacagccagccccaggttcccccagctctctccatctgcctggctccttgggacccgttccccagcctcaggatggcgtcctccctgcttgaggaggaagttcactatggctccagtcccctggccatgctgacggcagcgtgcagcaaatttggtggctctagccctctgcgggactcaacaactctgggcaaagcaggcacaaagaagccgtactctgtgggcagtgacctttcagcctccaaaaccatgggggatgcttatccagccccctttacaagcactaatgggctcctttcacctgcaggcagtcctccagcacccacctcaggctatgctaatgattaccctcccttttcccactcattccctgggcccacaggcacccaggaccctgggctactagtgcccaaggggcacagctcttctgactgtctgcccagtgtctacacctctctggacatgacacacccctatggctcctggtacaaggcaggcatccatgcaggcatttcaccaggcccaggcaacactcctactccatggtgggatatgcaccctggaggcaactggctaggtggtgggcagggccagggtgatgggctgcaagggacactgcccacaggtccagctcagcctccactgaacccccagctgcccacctacccatctgactttgctccccttaatccagccccctacccagctccccacctcttgcaaccagggccccagcatgtcttgccccaagatgtctataaacccaaggcagtgggaaatagtgggcagctagaagggagtggtggagccaaacccccacggggtgcaagcactgggggtagtggtggatatgggggcagtggggcagggcgctcctcctgcgactgccctaattgccaggagctagagcggctgggagcagcagcggctgggctgcggaagaagcccatccacagctgccacatccctggctgcggcaaggtgtatggcaaggcttcgcacctgaaggcccacttgcgctggcacacaggcgagaggcccttcgtctgcaactggctcttctgcggcaagaggttcactcgttcggatgagctggagcgtcatgtgcgcactcacacccgggagaagaagttcacctgcctgctctgctccaagcgctttacccgaagcgaccacctgagcaaacaccagcgcacccatggagaaccaggcccgggtccccctcccagtggccccaaggagctgggggagggccgcagcacgggggaagaggaggccagtcagacgccccgaccttctgcctcgccagcaaccccagagaaagcccctggaggcagccctgagcagagcaacttgctggagatctgagccgggtggaaggtctcccaccccagggctgccctgacagtctctcttggctctctagaccactgcttgccaatcactctctttaccccatgcatgccatccttcggggctctctccctctgtctccctcctggccattctgggcttgggtatctccttgcatgcctcctcagctcaccttctctcttcaccatgagactggctttccacaaactctcatctcaggccctccccttgtgcctgatacctgcactccggcttcctagactctggccctgccacaccaacacactttctatttgggctcccaacactatttctccatctcactccttgacatgtacccctttctgcttctcaagcttatttcctgctgtccctcagcctccaggcttcagtcttcccaacttcttacaccattgctttccattctccagaactcttttttcctttttacaaacacaatgataatgataatttattgccccctggtggcctcttcatcaggggtattggggttagtgacctggccagagggtgccaagaggggggcagaccagtggggatctgatcccaaagatggggtgaccccagggtcagggaggctgcccccaggcctgtatatttaacccctatgtaccaggagtaatgaatagtaataattctatttatgtaagttatgatgacgggtcaggtagagtgagctggggagggaagtggatccatttctgctaaggaaattctagtcaaatgcatctctgtatagacaaaatgttagtggagaagatcttgttaatagaatgtctatcatcagaatctcagttgatagggtttctcttgtaatgaagtctctacaaattgggttagctacatctctgctaaacagttgatggggtatctcttgattagggggatccctaatatccccagccccagccagaagctgtgaaacctcaagtcctatggaggggagaaggactggaatgtaccccatctcccttgactgcagagcaggttcctccactgccccaccccttagacaccatgaccccatcaggttaatcccctgttgccatggttatggagagcttgcagctgccatcttagatgtgctctttggggaagcccatctaacaggaggacattggtttgggggtgcacctcctgaagaatgggtggggaaggctttctctaggatcagattcaaataagtatgtattgagtgcctactctgtgcaaggcactatgctagatctggtgcctagaagccctgagaaagaacttaaagagctaggaggacagaggcccccaagctgatctggtggtgcatccacgcacccccaccctgggactttggatgctcccatctccacctccagtgacttttaaagccgcttcgtgcctttcctgtaacgttggatcctccttttctgtcccctgctgtctcaaggccccaagttaaagggttaaagccgctggagcttggggagagaacattgtggaatggaagggatcatgccctttgtggagtcttttttttttaatttaataaataaaagttggatttgaaa

SEQ ID NO: 185123 - DNA, 1042 bp, Homo sapiens
  Payload ID: 16453
  Gene Symbol: SP7
  Gene Name: Sp7 transcription factor
  ENST ID: ENST00000547755
  CDS Start-End: 236-1042
tgcattggggagcggaggataagagaatgggggagctctgagatccctactcctctctgtgtggggtgatggggaagagaaagggcatgagagactggcaggctgggggccaacgggatgttggcaccgtcgggacctcgggcactgcaagatccggaggaagaagcttggatgcagcctcgagaaagctacggcggaagaggaggaagttcactatggctccagtcccctggccatgctgacggcagcgtgcagcaaatttggtggctctagccctctgcgggactcaacaactctgggcaaagcaggcacaaagaagccgtactctgtgggcagtgacctttcagcctccaaaaccatgggggatgcttatccagccccctttacaagcactaatgggctcctttcacctgcaggcagtcctccagcacccacctcaggctatgctaatgattaccctcccttttcccactcattccctgggcccacaggcacccaggaccctgggctactagtgcccaaggggcacagctcttctgactgtctgcccagtgtctacacctctctggacatgacacacccctatggctcctggtacaaggcaggcatccatgcaggcatttcaccaggcccaggcaacactcctactccatggtgggatatgcaccctggaggcaactggctaggtggtgggcagggccagggtgatgggctgcaagggacactgcccacaggtccagctcagcctccactgaacccccagctgcccacctacccatctgactttgctccccttaatccagccccctacccagctccccacctcttgcaaccagggccccagcatgtcttgccccaagatgtctataaacccaaggcagtgggaaatagtgggcagctagaagggagtggtggagccaaacccccacggggtgcaagcactgggggtagtggtggatatgggggcagtggggcagggcgctcctcctgcgactgccctaattgccaggagctagagcggctgggagcagcagcggctggg

SEQ ID NO: 185124 - DNA, 1714 bp, Homo sapiens
  Payload ID: 16454
  Gene Symbol: SP8
  Gene Name: Sp8 transcription factor
  Uniprot ID: Q8IXZ3
  ENST ID: ENST00000361443
  CDS Start-End: 239-1711
attgtattgcacacctctaaaaaaaacactgcctctgatttatcaatataaaaaagatcctctgagaggaggagggcacttttgtgtgatggcaacttcacttctagggcgtggtgcttgctcccgaatcagacgccggcagccaaacttgtcccctcctgtagagtaggaagcggccgggcgccggggctgttgggggtgccaggaagaaccgaggttgggatcgactcctctggccatgcttgccgctacctgtaataagataggcagccccagcccgtctccctcctccctctcggacagctcttcttccttcggcaaaggcttccacccctggaaacgctcctcgtcctcttcttccgccagctgcaacgtagtgggttccagtctctcaagcttcggcgtgtccggggcctccaggaacggcggctcgtcctcggcggctgcggcggccgcggcagcagccgcggctgccgcggccctggtgtccgactcgttcagctgcggcggctcgcctggctccagcgccttctccctcacctccagcagcgccgcagccgccgccgccgccgccgcagccgccgcctccagctcgcccttcgccaacgactactctgttttccaggcccccggagtttccgggggcagcggcggcggcggcgggggcggcggcggcggctcctccgcgcactcgcaggacggctcccaccagccggtgttcatctccaaggtgcacacctctgtggacgggctgcagggcatctacccgcgggtgggcatggcgcacccgtacgagtcgtggtttaagccctcgcacccgggcctgggtgctgcgggcgaggtgggctcggccggcgcctccagctggtgggacgtgggggccggctggatcgacgtgcagaacccgaacagcgcggctgcgctgcccggctcgctgcaccctgccgccggggggctccaaacctcgctgcactcgccgctcggaggctacaactcggattactcgggcctgagtcactcggccttcagcagcggcgcctcctcgcacctgctcagccccgccgggcagcacctcatggacggcttcaagccagtgctacccggctcctacccggactcggccccgtcgccgctggccggcgcggggggctccatgttgagcgctgggccttcggcgccgctggggggctccccgcgctcctcagctcgccgctactccggccgcgccacctgcgactgccccaactgccaggaggcagagcggctgggccctgccggggcgagcttgcggcgcaagggcctgcacagctgccacatcccgggctgcggcaaggtgtacggcaagacttcgcacctcaaggcgcacctgcgctggcacacgggcgagcggcccttcgtgtgcaactggcttttctgcggcaagcgcttcacgcgctccgacgagctgcagcggcacctgcggacccacaccggcgagaagcgcttcgcctgtccagtttgcaacaagcgcttcatgcgcagcgaccacctcagcaagcacgtgaagacgcacagtggcggcggcggcggcggcggctcggcgggctcgggcagcggcggcaagaagggcagcgacaccgacagcgagcacagcgccgcgggcagcccgccctgccactccccagagctgctgcagccccccgagcccgggcaccgcaacggcctagagtgacgc

SEQ ID NO: 185125 - DNA, 1618 bp, Homo sapiens
  Payload ID: 16454
  Gene Symbol: SP8
  Gene Name: Sp8 transcription factor
  Uniprot ID: Q8IXZ3
  ENST ID: ENST00000418710
  CDS Start-End: 89-1615
attgtattgcacacctctaaaaaaaacactgcctctgatttatcaatataaaaaagatcctctgagaggaggagggcacttttgtgtgatggcaacttcacttctaggggaagaaccgaggttgggatcgactcctctggccatgcttgccgctacctgtaataagataggcagccccagcccgtctccctcctccctctcggacagctcttcttccttcggcaaaggcttccacccctggaaacgctcctcgtcctcttcttccgccagctgcaacgtagtgggttccagtctctcaagcttcggcgtgtccggggcctccaggaacggcggctcgtcctcggcggctgcggcggccgcggcagcagccgcggctgccgcggccctggtgtccgactcgttcagctgcggcggctcgcctggctccagcgccttctccctcacctccagcagcgccgcagccgccgccgccgccgccgcagccgccgcctccagctcgcccttcgccaacgactactctgttttccaggcccccggagtttccgggggcagcggcggcggcggcgggggcggcggcggcggctcctccgcgcactcgcaggacggctcccaccagccggtgttcatctccaaggtgcacacctctgtggacgggctgcagggcatctacccgcgggtgggcatggcgcacccgtacgagtcgtggtttaagccctcgcacccgggcctgggtgctgcgggcgaggtgggctcggccggcgcctccagctggtgggacgtgggggccggctggatcgacgtgcagaacccgaacagcgcggctgcgctgcccggctcgctgcaccctgccgccggggggctccaaacctcgctgcactcgccgctcggaggctacaactcggattactcgggcctgagtcactcggccttcagcagcggcgcctcctcgcacctgctcagccccgccgggcagcacctcatggacggcttcaagccagtgctacccggctcctacccggactcggccccgtcgccgctggccggcgcggggggctccatgttgagcgctgggccttcggcgccgctggggggctccccgcgctcctcagctcgccgctactccggccgcgccacctgcgactgccccaactgccaggaggcagagcggctgggccctgccggggcgagcttgcggcgcaagggcctgcacagctgccacatcccgggctgcggcaaggtgtacggcaagacttcgcacctcaaggcgcacctgcgctggcacacgggcgagcggcccttcgtgtgcaactggcttttctgcggcaagcgcttcacgcgctccgacgagctgcagcggcacctgcggacccacaccggcgagaagcgcttcgcctgtccagtttgcaacaagcgcttcatgcgcagcgaccacctcagcaagcacgtgaagacgcacagtggcggcggcggcggcggcggctcggcgggctcgggcagcggcggcaagaagggcagcgacaccgacagcgagcacagcgccgcgggcagcccgccctgccactccccagagctgctgcagccccccgagcccgggcaccgcaacggcctagagtgacgc

SEQ ID NO: 185126 - DNA, 3496 bp, Homo sapiens
  Payload ID: 16454
  Gene Symbol: SP8
  Gene Name: Sp8 transcription factor
  ENST ID: ENST00000617581
  CDS Start-End: 89-1489
attgtattgcacacctctaaaaaaaacactgcctctgatttatcaatataaaaaagatcctctgagaggaggagggcacttttgtgtgatggcaacttcacttctaggggaagaaccgaggttgggatcgactcctctggccatgcttgccgctacctgtaataagataggcagccccagcccgtctccctcctccctctcggacagctcttcttccttcggcaaaggcttccacccctggaaacgctcctcgtcctcttcttccgccagctgcaacgtagtgggttccagtctctcaagcttcggcgtgtccggggcctccaggaacggcggctcgtcctcggcggctgcggcggccgcggcagcagccgcggctgccgcggccctggtgtccgactcgttcagctgcggcggctcgcctggctccagcgccttctccctcacctccagcggcggctcctccgcgcactcgcaggacggctcccaccagccggtgttcatctccaaggtgcacacctctgtggacgggctgcagggcatctacccgcgggtgggcatggcgcacccgtacgagtcgtggtttaagccctcgcacccgggcctgggtgctgcgggcgaggtgggctcggccggcgcctccagctggtgggacgtgggggccggctggatcgacgtgcagaacccgaacagcgcggctgcgctgcccggctcgctgcaccctgccgccggggggctccaaacctcgctgcactcgccgctcggaggctacaactcggattactcgggcctgagtcactcggccttcagcagcggcgcctcctcgcacctgctcagccccgccgggcagcacctcatggacggcttcaagccagtgctacccggctcctacccggactcggccccgtcgccgctggccggcgcggggggctccatgttgagcgctgggccttcggcgccgctggggggctccccgcgctcctcagctcgccgctactccggccgcgccacctgcgactgccccaactgccaggaggcagagcggctgggccctgccggggcgagcttgcggcgcaagggcctgcacagctgccacatcccgggctgcggcaaggtgtacggcaagacttcgcacctcaaggcgcacctgcgctggcacacgggcgagcggcccttcgtgtgcaactggcttttctgcggcaagcgcttcacgcgctccgacgagctgcagcggcacctgcggacccacaccggcgagaagcgcttcgcctgtccagtttgcaacaagcgcttcatgcgcagcgaccacctcagcaagcacgtgaagacgcacagtggcggcggcggcggcggcggctcggcgggctcgggcagcggcggcaagaagggcagcgacaccgacagcgagcacagcgccgcgggcagcccgccctgccactccccagagctgctgcagccccccgagcccgggcaccgcaacggcctagagtgacgcccaccctgcgcccgcccctctccccgacctcctcccaccaagtcctcttgggccctgtctgtccggacttcaactccagcctttccctattgcatccgactcgctctctgtctctttctgtttctgcccctcttccttcttccttctgtgacttaactttgtaaaggggatatggacaagtaagtaacacgcatcgctgtcccgggccctggctttccctttccacgggtaacgctgcctgaacccgttgcagccggaacccgcgcctcgtcgggcctttatttctcgttctctcttccttgtcctcccctcctccaccccccaggttgtgaagggcgtaacttttagagggaacggccactggaggtagagctggactaatccagtgcctggtagacagcgggcctcgcgcgggcaggagcggctcggctgacaagcctgagcggagcggtggagagggagaggctggaggcctgggcagaacagcgccgcccgggcagacggctgcttggttccagagccgctgtactgagcacctcggcttcggagcaccctgccaggcccctgggcatcgccggacgtcctactcaggctgtcggggcttggtgggggtgacttttggcagcccgagacccagagtttgtagagtttagatctcccaatgtcagtctgcctctttttctttgttccctgaggtggaaccgatgcaagtttcagcaaagggcagtcttgtcgaatcgctgcagcagctttctttcatctttatagcatatattttatttttaaaaaaactagggggaaaatagcaaccttccatttggtttcccttctataatagttttttcctctaacggggagcaatctttctctcgaaactgctaatattgatcccaaagttactttgactgcattaacttaacttacggggtgggggcgggggtgagggtaggtgcttttttcttatgcaaaaatactcctttccggtgagaccagattaactatctccatgtttgtccttttctacctcgttttttcaccactcccaaacataacctcccaatcttttttgttagtccggccgtcaattgtatagtaccaatttcgtaaattctctcaattcatgaagatcgtagggttaaacttttttgtgtgtgatttaaacttacaaacaagtgaagaagctatcgtttatttcagacgaggctgtagtttaaataccaaaagagggaaaataaaaaagaacctttgtaaaatatatctgaacctaatggtttgtacaactggagaatcgttctagattagttaccaattaaatataactccgccagtgtaagggtgtgaggtgcagttgtccaggagacgattttgtatagtatttttcttgtacattacttccagtaaatatttgaaaatatattgaagtaaacttgattttttttttttgtcacaagaaaatattaagagttattgttgcagttctgatgagctgcaggttttttgaactcacttctggaggtgcagagccacaaacgcactttcggggcctagttttgctcgaatatgaatttagataggtatcaagctgtaactaagacaatatttgataaatgttggatgacatttaatttaatggagcatgtacttatttgcatttgctggcagttcaggcatagttaaagtgagagttctcctatatttcataataagtggtctgccaaaacccatgtattaaataaattgtccaagtgaaactcgactaactttggcctttgtgtatttcctgaaggtaatattgttaactgttaataaatacttctgacactacatttaaatgtttgcagattctgcaaactaattgctcattgtaatgttgaaataatttggatatttcacattgaaatgaaaagcctttctctggagcattttagatttgcattttaaatgcatgaaatgtaattgatttatttgtaatattttaaatggtataataaactcagataaaag

SEQ ID NO: 185127 - DNA, 2554 bp, Homo sapiens
  Payload ID: 16455
  Gene Symbol: SP9
  Gene Name: Sp9 transcription factor
  Uniprot ID: P0CG40
  ENST ID: ENST00000394967
  CDS Start-End: 148-1602
cttaggctgagtttagccggcgggagcctggagtccgctcggcacgagcgcggggacgcgggagccgcgcgggacccaagcagtttttccgagcagccgccaggctcagccccgctcccagcctcgctgcgcagccagagacctgctatggccacgtctatactcggggaagagccgcgcttcggaacgaccccgttggccatgctggcggcgacctgcaacaagatcggcaacacgagcccgctgacgacgctgccagagtcgagcgccttcgccaaaggcggctttcacccctggaagcgctcctcgtccagctgcaacctcggctccagcctctcgggcttcgcggtggccaccgggggccgtggctcgggcggcctggcgggcggctcgggcgccgccaacagcgccttctgcctggcctccacgtcgcccacgtcgtccgccttcagcagcgactacggcggcctcttctccaactcggcggctgccgcggcggcagcggccggggtgtccccgcaggaggcgggtggccagtcggccttcatttccaaggtgcacacgacggcagccgacgggctgtacccgcgcgtgggcatggcgcacccgtacgagtcctggtacaagtcgggcttccattcgacgctggcggccggcgaggtgaccaacggcgcggcgtcgtcgtggtgggacgtgcacagcagcccgggctcgtggctggaagtgcagaaccccgctggggggctccagagctcgctgcactcgggcgccccccaggcctcgctgcactcgcagctgggcacctacaaccccgacttcagctcgctcacgcactccgccttcagctccacgggcctcggctcctccgccgccgccgcctcccacctgctctccaccagccagcacctgctggcccaggacggcttcaagccggtgttgccctcctattcggactccagcgccgccgtggcagccgccgccgccagcgccatgatatcgggcgccgcggctgccgccgccggggggagctcggcacgctctgcccgccgctactcgggccgcgccacctgcgactgccccaactgccaggaggcggagcggctgggcccggccggggcgagcctgcggcgcaagggcctgcacagctgccacattccgggctgcggcaaggtgtacgggaagacgtcgcacctgaaggcgcacctgcgctggcacacgggcgagcggcccttcgtgtgcaactggctcttctgcggcaagcgcttcacgcgctcggacgagctgcagcggcatctgcggactcacacgggcgagaagcgcttcgcctgtccggtgtgcaacaagcgcttcatgcgcagcgaccacctgagcaaacacattaagacgcacaacgggggcggcgggggcaaaaagggcagcgacagtgacacggacgccagcaacctggagacgccccgttccgaatcccccgacctcatcctgcatgactccggcgtcagtgccgcccgggcggcggcagcggcggcggcggcagcggcggcggcggcggcggcggcctccgcgggaggcaaggaagcagcgtctggccccaacgactcttagaggccgggcgagaggcgcgagcacacaagcgagtagagacaccgagaacgaacgagaggttcggagggcgagcgagcgggaggcgggagggcaggggcttcagtgacgcccccagggcccgggctgggcgcgaggtggagccgctcagggctcccgggctgcggttcgcccgctgtgcgaggagctcccctctgccttccgcgcccggataagaatcgaacgcgtggtccggaaacaaaagcgaaccatcctccgacacaaacactttaaaaactgtactcccagacgtacacatacaccggagacctacaaccacaagcacgcacactcgcgcgcgcacacacataccactcgcccaaacttctcgagcgaagagcaatacatagaaaggctccctctttgcccactctccacctccctccaacacccgtctctttccttttctcaaaaacaagccaccacccagcaaaggactgtcagaacatttgaaaacaaacgggaccgataaaaacaccctttgtttggattatattatatataaaatgctccaagtcctgcctgatatctacttacaatgagacttttttcctaaaaaaggaagcatcaaaaggcttaaggtgagaaattaaactggaagtctagcgacagtttctctgtatttcataacatctgtataaatagggttcaaaagattgtgttctcttttattttcttgtaaatgttcattcgaatagagtttttttgggtgaatccctgaaattcagggagttttttttaattttctgatgcactttgtgaaagtcagtatatatgtaaaagatatttaaaatgttgagttatcatttcactcacaaacacgtaagttaaggtcatctaaagaaattaaatgcgtttatctgtatcaagaaaatcttgacatcatattttcattttggtattattaaaggactct

SEQ ID NO: 185128 - DNA, 5146 bp, Homo sapiens
  Payload ID: 16456
  Gene Symbol: SALL1
  Gene Name: spalt-like transcription factor 1
  Uniprot ID: Q9NSC2
  ENST ID: ENST00000251020
  CDS Start-End: 35-4009
tttttattctgccccagctgatgtttgagccagcatgtcgcggaggaagcaagcgaagcctcaacatttccaatccgaccccgaagtggcctcgctcccccggcgagatggagacacagaaaagggtcaaccgagtcgccctactaagagcaaggatgcccacgtctgtggccggtgctgtgccgagttctttgaattatcagatcttctgctccacaagaagaactgtactaaaaatcaattagttttaatcgtaaatgaaaatccagcctccccacccgaaaccttctcccccagcccccctcctgataatcctgatgaacaaatgaatgacacagttaacaaaacagatcaagtggactgcagcgacctttcagaacacaacggacttgacagggaagagtccatggaggtggaggccccggttgctaacaaaagcggcagcggcacttccagcggcagccacagcagtaccgccccaagcagcagcagcagcagcagcagcagcagcggcggcggcggcagctcctccacaggtacctcagcgatcacaacctctctacctcaactcggggacctgacaacactgggcaacttctccgtaatcaacagcaacgtcatcatcgagaacctccagagcaccaaggtggcggtggcccagttctcccaggaagcgaggtgcggcggggcctctgggggcaagctggccgtcccagccctcatggaacaactcctagctctgcagcagcagcagatccaccagctgcaattgatcgaacagattcgtcaccaaatattgctgttggcttctcagaatgcagacttgccaacatcttctagtccttctcaaggtactttacgaacatctgccaaccccttgtccacgctaagttcccatttatctcagcagctggcagcagcagctggattggcacagagcctcgccagccaatctgccagcattagtggtgtgaaacagctacccccaatccagctacctcagagcagttctggcaacaccatcattccatccaacagcggctcttctcccaatatgaacatattggcagcggcagttaccaccccgtcctctgaaaaagtggcttcaagtgctggggcctcccatgtcagcaacccagcggtctcatcatcgtcctcaccagcttttgcaataagcagtttattaagtcctgcgtctaatccacttctacctcagcaagcctccgctaactcggttttccccagccctttgcccaacatcggaacaactgcagaggatttaaactccttgtctgccttggcccagcaaagaaaaagcaagccaccaaatgtcactgcctttgaagcgaaaagtacttccgatgaggcattcttcaaacacaagtgcaggttctgcgcgaaggtctttgggagtgacagtgccttgcagatccacttgcgttcccataccggagagaggccattcaagtgcaacatctgcgggaacaggttctccaccaaggggaatctgaaagtccactttcagcgccacaaagagaaataccctcatatccagatgaacccctatcctgtgcctgagcatttggacaatatccccacgagtactggcatcccatatggcatgtccatccctccagagaagccagtcaccagctggctagacaccaaaccagtcctgcctactctgaccacttcagtcggcctgccgttgcccccaaccctcccaagcctcatacccttcatcaagacggaagagccagcccccatccccatcagccattctgccaccagccccccaggctcagtcaaaagtgactccgggggccctgagtcagccacaagaaacctaggtgggctcccagaggaagccgaagggtccactctgccaccctctggtggcaaaagcgaagagagtggcatggtcaccaactcagtcccgacggcgagcagtagcgtcctgagctccccagcggcagactgcggccccgcgggcagtgccaccaccttcaccaaccctttgttgccgctcatgtccgagcagttcaaggccaagtttccttttgggggactcctggactcagctcaggcatcagagacgtccaagcttcagcaactggtagaaaacattgacaagaaggccactgaccccaatgagtgcatcatctgccaccgggttctcagctgccagagcgccttgaaaatgcactacaggacacacactggggagaggccctttaagtgtaagatctgtggccgggctttcaccacgaaagggaatcttaaaacccactacagtgtccatcgtgctatgcccccgctcagagtccagcattcctgccccatctgccagaagaagttcacgaacgctgtggtcctgcagcagcacatccgaatgcatatgggaggccagatccccaacaccccagtccccgacagctactctgagtccatggagtctgacacaggttcctttgatgagaaaaattttgatgacctagacaacttctctgatgaaaacatggaagactgtcctgagggcagcatccctgatacacctaagtctgcagacgcctcccaagacagcttatcctcttcgcctttgcccctcgagatgtcgagcatcgctgctttggaaaatcagatgaagatgatcaatgctggcctggcagagcagctacaggccagcctgaagtcagtggagaatgggtccatcgagggggatgtcctgaccaatgattcatcctcagtgggtggtgacatggaaagccaaagtgctggcagcccagccatctcagagtctacctcttccatgcaggctctgtccccgtccaacagcacgcaggagttccacaagtcacccagcattgaggagaaaccacagagagcggtcccaagcgagtttgccaatggtttgtctcccaccccagtgaatggtggggctttggatttgacatctagtcacgcagagaaaatcatcaaagaagattctttggggatcctcttcccttttagagaccggggtaaatttaaaaacactgcttgtgacatttgtggcaaaacatttgcttgtcagagtgccttggacattcactatagaagtcataccaaagagagaccatttatttgcacagtttgcaatcgtggcttttccacaaagggtaatttgaagcagcacatgttgacacatcagatgcgagatctgccatcccagctctttgagcccagttccaaccttggccccaatcagaactcagcggtgattcccgccaactcgttgtcatctctcatcaagacagaggtcaacggcttcgtgcatgtttctcctcaggacagtaaggacacccccaccagtcacgtcccgtctgggcctctgtcttcctctgccacatccccagttctgctccctgctctgcccaggagaactcccaagcagcactactgcaacacatgtggcaaaaccttctcctcatcgagtgccctgcagattcacgagagaactcacactggagagaaaccctttgcttgcactatttgtggaagagctttcacgactaaaggcaatcttaaggtacacatgggcactcacatgtggaatagcacccctgcacgacggggtcggcggctctctgtggatggccccatgacatttctaggaggcaatcccgtcaagttcccagaaatgttccagaaggatttggcggcaagatcaggaagtggggatccttccagcttctggaatcagtatgcagcagcgctctccaacgggctggcgatgaaggccaacgagatctccgtcattcagaacggtggcatccctccaattcctggaagcctcggcagtgggaacagctcacctgttagtgggctgacgggaaacctggagaggctccagaactcagagcccaatgctcccctggccggcctggagaaaatggcaagcagtgagaacggaaccaacttccgcttcacccgcttcgtggaggacagcaaggagatcgtcacgagttaaagcagctcgggctggagacatagcattcattcctgttcagaatgcgacctatggtggcctcctactccttgccccccaccccgccccgccccttccttctgttccccagatctatgaactacaacattatgaagacattcttttgtaccttgttcaactttagagttctaagaaagcttatttattagcgatataaccttgctttgcaaacagaatgcaagcgttaactttggtcttctgtattttggactaaatactaattgactagagtgctgtaaacttgctgtaacatttatggcaattgcaagttgccctgctaggcagttgtaatctggcattaacttattttctatatccagtttaatatgaatctggtgttgatgcaatgcctcagtgatgcattagatctctaataaagtctgtatatacatgtacactttgatcctgctggaaaattttatcagcaaacacattgtctaatctttcaaaacagatttaaggaaaggactgaaagtacagactgaacagtgtggttctttgaaaggtttggttttttaatttttattctaaaattcaacctttttttttgtcgatttaaccatttccattttgaactgctatttgtattgtgctttttacttgagtcgtcttcaatgttaataagtttctgtacagtaataagcacgcagaattctttagagaaaaagaaaacaagcgttgttttggtagttgaaactgagacgtaacattttgccttgtaggtatattcacgatagaaaatgtgtgctggaatttcacaatgctgctaagtatagcatcttgaacaaccttcagtggagaaaatgtagatgctcttgtatatacaataagaaatatcactttcattcaaatgtacatatgttccttacaagagcaaatgcttcttcttgatcaagagagcaggtatagtgtttgtttattttgtcttaggtatggaagaaaaaaattggactgttacatgcactttcttggaaagttgaaaggaaagggggggtccaatttctttaacatttaatacttactaacaacagagatactgtaattttactcaagtaatcaaatacattttttttgcaacagataaaacaaaatactgtg

SEQ ID NO: 185129 - DNA, 5253 bp, Homo sapiens
  Payload ID: 16456
  Gene Symbol: SALL1
  Gene Name: spalt-like transcription factor 1
  Uniprot ID: Q9NSC2
  ENST ID: ENST00000440970
  CDS Start-End: 433-4116
ctttggaggttcagagctgcaagaagatggggactggtgtcggggcgccagcgcctgacccgctggggttgcggccggggtggagagtgctgctggccgccagttgttccggagacggtgcaaacggacggggaaagtgtcggggtctggctcgcaaaatttatctccgcatctcttcccacaacacttgcaccctctgccccccaaaatctttctggagacacagaaaagggtcaaccgagtcgccctactaagagcaaggatgcccacgtctgtggccggtgctgtgccgagttctttgaattatcagatcttctgctccacaagaagaactgtactaaaaatcaattagttttaatcgtaaatgaaaatccagcctccccacccgaaaccttctcccccagcccccctcctgataatcctgatgaacaaatgaatgacacagttaacaaaacagatcaagtggactgcagcgacctttcagaacacaacggacttgacagggaagagtccatggaggtggaggccccggttgctaacaaaagcggcagcggcacttccagcggcagccacagcagtaccgccccaagcagcagcagcagcagcagcagcagcagcggcggcggcggcagctcctccacaggtacctcagcgatcacaacctctctacctcaactcggggacctgacaacactgggcaacttctccgtaatcaacagcaacgtcatcatcgagaacctccagagcaccaaggtggcggtggcccagttctcccaggaagcgaggtgcggcggggcctctgggggcaagctggccgtcccagccctcatggaacaactcctagctctgcagcagcagcagatccaccagctgcaattgatcgaacagattcgtcaccaaatattgctgttggcttctcagaatgcagacttgccaacatcttctagtccttctcaaggtactttacgaacatctgccaaccccttgtccacgctaagttcccatttatctcagcagctggcagcagcagctggattggcacagagcctcgccagccaatctgccagcattagtggtgtgaaacagctacccccaatccagctacctcagagcagttctggcaacaccatcattccatccaacagcggctcttctcccaatatgaacatattggcagcggcagttaccaccccgtcctctgaaaaagtggcttcaagtgctggggcctcccatgtcagcaacccagcggtctcatcatcgtcctcaccagcttttgcaataagcagtttattaagtcctgcgtctaatccacttctacctcagcaagcctccgctaactcggttttccccagccctttgcccaacatcggaacaactgcagaggatttaaactccttgtctgccttggcccagcaaagaaaaagcaagccaccaaatgtcactgcctttgaagcgaaaagtacttccgatgaggcattcttcaaacacaagtgcaggttctgcgcgaaggtctttgggagtgacagtgccttgcagatccacttgcgttcccataccggagagaggccattcaagtgcaacatctgcgggaacaggttctccaccaaggggaatctgaaagtccactttcagcgccacaaagagaaataccctcatatccagatgaacccctatcctgtgcctgagcatttggacaatatccccacgagtactggcatcccatatggcatgtccatccctccagagaagccagtcaccagctggctagacaccaaaccagtcctgcctactctgaccacttcagtcggcctgccgttgcccccaaccctcccaagcctcatacccttcatcaagacggaagagccagcccccatccccatcagccattctgccaccagccccccaggctcagtcaaaagtgactccgggggccctgagtcagccacaagaaacctaggtgggctcccagaggaagccgaagggtccactctgccaccctctggtggcaaaagcgaagagagtggcatggtcaccaactcagtcccgacggcgagcagtagcgtcctgagctccccagcggcagactgcggccccgcgggcagtgccaccaccttcaccaaccctttgttgccgctcatgtccgagcagttcaaggccaagtttccttttgggggactcctggactcagctcaggcatcagagacgtccaagcttcagcaactggtagaaaacattgacaagaaggccactgaccccaatgagtgcatcatctgccaccgggttctcagctgccagagcgccttgaaaatgcactacaggacacacactggggagaggccctttaagtgtaagatctgtggccgggctttcaccacgaaagggaatcttaaaacccactacagtgtccatcgtgctatgcccccgctcagagtccagcattcctgccccatctgccagaagaagttcacgaacgctgtggtcctgcagcagcacatccgaatgcatatgggaggccagatccccaacaccccagtccccgacagctactctgagtccatggagtctgacacaggttcctttgatgagaaaaattttgatgacctagacaacttctctgatgaaaacatggaagactgtcctgagggcagcatccctgatacacctaagtctgcagacgcctcccaagacagcttatcctcttcgcctttgcccctcgagatgtcgagcatcgctgctttggaaaatcagatgaagatgatcaatgctggcctggcagagcagctacaggccagcctgaagtcagtggagaatgggtccatcgagggggatgtcctgaccaatgattcatcctcagtgggtggtgacatggaaagccaaagtgctggcagcccagccatctcagagtctacctcttccatgcaggctctgtccccgtccaacagcacgcaggagttccacaagtcacccagcattgaggagaaaccacagagagcggtcccaagcgagtttgccaatggtttgtctcccaccccagtgaatggtggggctttggatttgacatctagtcacgcagagaaaatcatcaaagaagattctttggggatcctcttcccttttagagaccggggtaaatttaaaaacactgcttgtgacatttgtggcaaaacatttgcttgtcagagtgccttggacattcactatagaagtcataccaaagagagaccatttatttgcacagtttgcaatcgtggcttttccacaaagggtaatttgaagcagcacatgttgacacatcagatgcgagatctgccatcccagctctttgagcccagttccaaccttggccccaatcagaactcagcggtgattcccgccaactcgttgtcatctctcatcaagacagaggtcaacggcttcgtgcatgtttctcctcaggacagtaaggacacccccaccagtcacgtcccgtctgggcctctgtcttcctctgccacatccccagttctgctccctgctctgcccaggagaactcccaagcagcactactgcaacacatgtggcaaaaccttctcctcatcgagtgccctgcagattcacgagagaactcacactggagagaaaccctttgcttgcactatttgtggaagagctttcacgactaaaggcaatcttaaggtacacatgggcactcacatgtggaatagcacccctgcacgacggggtcggcggctctctgtggatggccccatgacatttctaggaggcaatcccgtcaagttcccagaaatgttccagaaggatttggcggcaagatcaggaagtggggatccttccagcttctggaatcagtatgcagcagcgctctccaacgggctggcgatgaaggccaacgagatctccgtcattcagaacggtggcatccctccaattcctggaagcctcggcagtgggaacagctcacctgttagtgggctgacgggaaacctggagaggctccagaactcagagcccaatgctcccctggccggcctggagaaaatggcaagcagtgagaacggaaccaacttccgcttcacccgcttcgtggaggacagcaaggagatcgtcacgagttaaagcagctcgggctggagacatagcattcattcctgttcagaatgcgacctatggtggcctcctactccttgccccccaccccgccccgccccttccttctgttccccagatctatgaactacaacattatgaagacattcttttgtaccttgttcaactttagagttctaagaaagcttatttattagcgatataaccttgctttgcaaacagaatgcaagcgttaactttggtcttctgtattttggactaaatactaattgactagagtgctgtaaacttgctgtaacatttatggcaattgcaagttgccctgctaggcagttgtaatctggcattaacttattttctatatccagtttaatatgaatctggtgttgatgcaatgcctcagtgatgcattagatctctaataaagtctgtatatacatgtacactttgatcctgctggaaaattttatcagcaaacacattgtctaatctttcaaaacagatttaaggaaaggactgaaagtacagactgaacagtgtggttctttgaaaggtttggttttttaatttttattctaaaattcaacctttttttttgtcgatttaaccatttccattttgaactgctatttgtattgtgctttttacttgagtcgtcttcaatgttaataagtttctgtacagtaataagcacgcagaattctttagagaaaaagaaaacaagcgttgttttggtagttgaaactgagacgtaacattttgccttgtaggtatattcacgatagaaaatgtgtgctggaatttcacaatgctgctaagtatagcatcttgaacaaccttcagtggagaaaatgtagatgctcttgtatatacaataagaaatatcactttcattcaaatgtacatatgttccttacaagagcaaatgcttcttcttgatcaagagagcaggtatagtgtttgtttattttgtcttaggtatggaagaaaaaaattggactgttacatgcactttcttggaaagttgaaaggaaagggggggtccaatttctttaacatttaatacttactaacaacagagatactgtaattttactcaagtaatcaaatacattttttttgcaacagataaaacaaaatactgtg

SEQ ID NO: 185130 - DNA, 565 bp, Homo sapiens
  Payload ID: 16456
  Gene Symbol: SALL1
  Gene Name: spalt-like transcription factor 1
  ENST ID: ENST00000566102
  CDS Start-End: 1-105
atgtcgcggaggaagcaagcgaagcctcaacatttccaatccgaccccgaagtggcctcgctcccccggcgagatggtacacatgggcactcacatgtggaatagcacccctgcacgacggggtcggcggctctctgtggatggccccatgacatttctaggaggcaatcccgtcaagttcccagaaatgttccagaaggatttggcggcaagatcaggaagtggggatccttccagcttctggaatcagtatgcagcagcgctctccaacgggctggcgatgaaggccaacgagatctccgtcattcagaacggtggcatccctccaattcctggaagcctcggcagtgggaacagctcacctgttagtgggctgacgggaaacctggagaggctccagaactcagagcccaatgctcccctggccggcctggagaaaatggcaagcagtgagaacggaaccaacttccgcttcacccgcttcgtggaggacagcaaggagatcgtcacgagttaaagcagctcgggctggagacatagcattcattcctgttcagaatgcgac

SEQ ID NO: 185131 - DNA, 3896 bp, Homo sapiens
  Payload ID: 16456
  Gene Symbol: SALL1
  Gene Name: spalt-like transcription factor 1
  ENST ID: ENST00000570206
  CDS Start-End: 433-3896
ctttggaggttcagagctgcaagaagatggggactggtgtcggggcgccagcgcctgacccgctggggttgcggccggggtggagagtgctgctggccgccagttgttccggagacggtgcaaacggacggggaaagtgtcggggtctggctcgcaaaatttatctccgcatctcttcccacaacacttgcaccctctgccccccaaaatctttctggagacacagaaaagggtcaaccgagtcgccctactaagagcaaggatgcccacgtctgtggccggtgctgtgccgagttctttgaattatcagatcttctgctccacaagaagaactgtactaaaaatcaattagttttaatcgtaaatgaaaatccagcctccccacccgaaaccttctcccccagcccccctcctgataatcctgatgaacaaatgaatgacacagttaacaaaacagatcaagtggactgcagcgacctttcagaacacaacggacttgacagggaagagtccatggaggtggaggccccggttgctaacaaaagcggcagcggcacttccagcggcagccacagcagtaccgccccaagcagcagcagcagcagcagcagcagcagcggcggcggcggcagctcctccacaggtacctcagcgatcacaacctctctacctcaactcggggacctgacaacactgggcaacttctccgtaatcaacagcaacgtcatcatcgagaacctccagagcaccaaggtggcggtggcccagttctcccaggaagcgaggtgcggcggggcctctgggggcaagctggccgtcccagccctcatggaacaactcctagctctgcagcagcagcagatccaccagctgcaattgatcgaacagattcgtcaccaaatattgctgttggcttctcagaatgcagacttgccaacatcttctagtccttctcaaggtactttacgaacatctgccaaccccttgtccacgctaagttcccatttatctcagcagctggcagcagcagctggattggcacagagcctcgccagccaatctgccagcattagtggtgtgaaacagctacccccaatccagctacctcagagcagttctggcaacaccatcattccatccaacagcggctcttctcccaatatgaacatattggcagcggcagttaccaccccgtcctctgaaaaagtggcttcaagtgctggggcctcccatgtcagcaacccagcggtctcatcatcgtcctcaccagcttttgcaataagcagtttattaagtcctgcgtctaatccacttctacctcagcaagcctccgctaactcggttttccccagccctttgcccaacatcggaacaactgcagaggatttaaactccttgtctgccttggcccagcaaagaaaaagcaagccaccaaatgtcactgcctttgaagcgaaaagtacttccgatgaggcattcttcaaacacaagtgcaggttctgcgcgaaggtctttgggagtgacagtgccttgcagatccacttgcgttcccataccggagagaggccattcaagtgcaacatctgcgggaacaggttctccaccaaggggaatctgaaagtccactttcagcgccacaaagagaaataccctcatatccagatgaacccctatcctgtgcctgagcatttggacaatatccccacgagtactggcatcccatatggcatgtccatccctccagagaagccagtcaccagctggctagacaccaaaccagtcctgcctactctgaccacttcagtcggcctgccgttgcccccaaccctcccaagcctcatacccttcatcaagacggaagagccagcccccatccccatcagccattctgccaccagccccccaggctcagtcaaaagtgactccgggggccctgagtcagccacaagaaacctaggtgggctcccagaggaagccgaagggtccactctgccaccctctggtggcaaaagcgaagagagtggcatggtcaccaactcagtcccgacggcgagcagtagcgtcctgagctccccagcggcagactgcggccccgcgggcagtgccaccaccttcaccaaccctttgttgccgctcatgtccgagcagttcaaggccaagtttccttttgggggactcctggactcagctcaggcatcagagacgtccaagcttcagcaactggtagaaaacattgacaagaaggccactgaccccaatgagtgcatcatctgccaccgggttctcagctgccagagcgccttgaaaatgcactacaggacacacactggggagaggccctttaagtgtaagatctgtggccgggctttcaccacgaaagggaatcttaaaacccactacagtgtccatcgtgctatgcccccgctcagagtccagcattcctgccccatctgccagaagaagttcacgaacgctgtggtcctgcagcagcacatccgaatgcatatgggaggccagatccccaacaccccagtccccgacagctactctgagtccatggagtctgacacaggttcctttgatgagaaaaattttgatgacctagacaacttctctgatgaaaacatggaagactgtcctgagggcagcatccctgatacacctaagtctgcagacgcctcccaagacagcttatcctcttcgcctttgcccctcgagatgtcgagcatcgctgctttggaaaatcagatgaagatgatcaatgctggcctggcagagcagctacaggccagcctgaagtcagtggagaatgggtccatcgagggggatgtcctgaccaatgattcatcctcagtgggtggtgacatggaaagccaaagtgctggcagcccagccatctcagagtctacctcttccatgcaggctctgtccccgtccaacagcacgcaggagttccacaagtcacccagcattgaggagaaaccacagagagcggtcccaagcgagtttgccaatggtttgtctcccaccccagtgaatggtggggctttggatttgacatctagtcacgcagagaaaatcatcaaagaagattctttggggatcctcttcccttttagagaccggggtaaatttaaaaacactgcttgtgacatttgtggcaaaacatttgcttgtcagagtgccttggacattcactatagaagtcataccaaagagagaccatttatttgcacagtttgcaatcgtggcttttccacaaagggtaatttgaagcagcacatgttgacacatcagatgcgagatctgccatcccagctctttgagcccagttccaaccttggccccaatcagaactcagcggtgattcccgccaactcgttgtcatctctcatcaagacagaggtcaacggcttcgtgcatgtttctcctcaggacagtaaggacacccccaccagtcacgtcccgtctgggcctctgtcttcctctgccacatccccagttctgctccctgctctgcccaggagaactcccaagcagcactactgcaacacatgtggcaaaaccttctcctcatcgagtgccctgcagattcacgagagaactcacactggagagaaaccctttgcttgcactatttgtggaagagctttcacgactaaaggcaatcttaaggtacacatgggcactcacatgtggaatagcacccctgcacgacggggtcggcggctctctgtggatggccccatgacatttctaggaggcaatcccgtcaagttcccagaaatgttccagaaggatttggcggcaagatcaggaagtggggatccttccagcttctggaatcagtatgcagcagcgctctccaacgggctggcgatgaaggccaacgagat

SEQ ID NO: 185132 - DNA, 3178 bp, Homo sapiens
  Payload ID: 16457
  Gene Symbol: SALL2
  Gene Name: spalt-like transcription factor 2
  ENST ID: ENST00000450879
  CDS Start-End: 101-2821
ctgggtgcagaggctgccgcagacccagcggccatcgcctccctcaatcccaatatccattgtctcccaccccacctggccctccacttcccccacaaccatggcgcacgaatccgagaggagctctcgtctcggggtgccctgcggggagccggcagagctcggaggtgatgctagcgaggaggatcacccccaagtctgtgccaagtgctgcgcacaattcactgacccaactgaattcctcgcccaccagaacgcatgttctactgaccctcctgtaatggtgataattgggggccaggagaaccccaacaactcttcggcctcctctgaaccccggcctgagggtcacaataatcctcaggtcatggacacagagcatagcaaccccccagattctgggtcctccgtgcccacggatcccacctggggcccagagaggagaggagaggagtcttcagggcatttcctggtcgctgccacaggggcagaaacgcccaagcaggccttcttccacctttaccacccactggggtcacagcatcctttctctgctggaggggttgggcgaagccacaaacccacccctgccccttccccagccttgccaggcagcacagatcagctgattgcctcgcctcatctggcattcccaagcaccacgggactactggcagcacagtgtcttggggcagcccgaggccttgaggccactgcctccccagggctcctgaagccaaagaatggaagtggtgagctgagctacggagaagtgatgggtcccttggagaagcctggtggaaggcacaaatgccgcttctgtgccaaagtatttggcagtgacagtgccctgcagatccaccttcgttcccacacgggtgagaggccctataagtgcaatgtctgtggaaaccgttttaccacccgtggcaacctcaaagtgcatttccaccggcatcgtgagaagtacccacatgtgcagatgaacccacacccagtaccagagcacctagactatgtcattaccagcagtggcttgccttatggtatgtccgtgccaccagagaaggccgaggaggaggcagccactccaggtggaggggttgagcgcaagcctctggtggcctccacaacagcactcagtgccacagagagcctgactctgctctccaccagtgcaggcacagccacggctccaggactccctgctttcaataagtttgtgctcatgaaagcagtggaacccaagaataaagctgatgaaaacacccccccagggagtgagggctcagccatcagtggagtggcagaaagtagcacggcaactcgcatgcaactaagtaagttggtgacttcactaccaagctgggcactgcttaccaaccacttcaagtccactggcagcttccccttcccctatgtgctagagcccttgggggcctcaccctctgagacatcaaagctgcagcaactggtagaaaagattgaccggcaaggagctgtggcggtgacctcagctgcctcaggagcccccaccacctctgcccctgcaccttcatcctcagcctcttctggacctaaccagtgtgtcatctgtctccgagtgcttagctgtcctcgggccctacgccttcattatggccaacatggaggtgagaggcccttcaaatgcaaagtgtgtggcagagccttctccaccaggggtaatctgcgtgcacatttcgtgggccacaaggccagtccagctgcccgggcacagaattcctgccccatctgccagaagaagttcaccaatgctgtcactctgcagcagcatgtccggatgcacctggggggccagatccccaacggtggtactgcactccctgaaggtggaggagctgctcaggagaatggctccgagcaatctacagtctccggggcacggagtttcccccagcagcagtcccagcagccatcaccggaagaggagttgtctgaggaggaggaagaggaggatgaggaagaagaggaagatgtgactgatgaagattccctggcagggagaggctcagagagtggaggtgagaaggcaatatcagtgagaggtgattcagaagaggcatctggggcagaggaggaggtggggacagtggcggcagcagccacagctgggaaggagatggacagtaatgagaaaactactcaacagtcttctttgccaccaccaccaccacctgacagcctggatcagcctcagccaatggagcagggaagcagtggtgttttaggaggcaaggaagaggggggcaaaccggagagaagctcaagtccggcatcagcactcaccccagaaggggaagccaccagcgtgaccttggtagaggagctgagcctgcaggaggcaatgagaaaggagccaggagagagcagcagcagaaaggcctgcgaagtgtgtggccaggcctttccctcccaggcagctctggaggagcatcagaagacccaccccaaggaggggccgctcttcacttgtgttttctgcaggcagggctttcttgagcgggctaccctcaagaagcatatgctcctggcacaccaccagaaccagtatgtggcattcctgtcaaatggcctgcccatgaagccctggaattccagctccacctccactaccactccaagcctggccccaccagtgctgtttggcctaggaactgtggctgggaaggtgcctccaacaatgggatccagggaagccaaggagaagacagcccccctcctatttcagcctcctgcacccaaggcagtgcctgagaagcccatcatagacaagaagtagcaaactgtacattccttcttcctccccctgctccagaaggtgccggtactgaagatgctccagtaattggtgacccaaccctaggaagtagggagaaatgaaggaagggcataggaaaattttcccagtaaatcccctgatggtcacattaaggtaaaggttttggctggtcagtgtgccaagacctctccagcttctcattcatgatgacctctcaaagttgggaaacaagctgatttcttgccaagaggtctcccaggagatatttgggaaatgtgaagttcgtatctttaaggagcatttttggtcagcatggttgatgaactaatgatgagagagttaaggaatgttgctaga

SEQ ID NO: 185133 - DNA, 659 bp, Homo sapiens
  Payload ID: 16457
  Gene Symbol: SALL2
  Gene Name: spalt-like transcription factor 2
  ENST ID: ENST00000537235
  CDS Start-End: 87-659
tgccgcagacccagcggccatcgcctccctcaatcccaatatccattgtctcccaccccacctggccctccacttcccccacaaccatggcgcacgaatccgagaggagctctcgtctcggggtgccctgcggggagccggcagagctcggaggtgatgctagcgaggaggatcacccccaagtctgtgccaagtgctgcgcacaattcactgacccaactgaattcctcgcccaccagaacgcatgttctactgaccctcctgtaatggtgataattgggggccaggagaaccccaacaactcttcggcctcctctgaaccccggcctgagggtcacaataatcctcaggtcatggacacagagcatagcaaccccccagattctgggtcctccgtgcccacggatcccacctggggcccagagaggagaggagaggagtcttcagggcatttcctggtcgctgccacaggtacagcggctgggggaggcgggggcctgatcttggccagtcccaagctgggagcaaccccattacctccagaatcgacccctgcaccccctcctcctccaccaccccctccgcccccaggggtaggcagtggccacttgaatatccccctgatcttggaagagctacgggtgctgcagcagcggcag

SEQ ID NO: 185134 - DNA, 553 bp, Homo sapiens
  Payload ID: 16457
  Gene Symbol: SALL2
  Gene Name: spalt-like transcription factor 2
  ENST ID: ENST00000541965
  CDS Start-End: 257-553
agagaatcagagagagagagagagtctgtgtctctgggaaagaagaacatctctgcttcacagtgatttgcgctgggggagaggcatcaattggcttcggacccaagggggagacgagaccaggtcaccccggttaagaccaagtgatgctagcgaggaggatcacccccaagtctgtgccaagtgctgcgcacaattcactgacccaactgaattcctcgcccaccagaacgcatgttctactgaccctcctgtaatggtgataattgggggccaggagaaccccaacaactcttcggcctcctctgaaccccggcctgagggtcacaataatcctcaggtcatggacacagagcatagcaaccccccagattctgggtcctccgtgcccacggatcccacctggggcccagagaggagaggagaggagtcttcagggcatttcctggtcgctgccacaggtacagcggctgggggaggcgggggcctgatcttggccagtcccaagctgggagcaaccccattacctccagaatcgacccctgcaccccct

SEQ ID NO: 185135 - DNA, 3094 bp, Homo sapiens
  Payload ID: 16457
  Gene Symbol: SALL2
  Gene Name: spalt-like transcription factor 2
  ENST ID: ENST00000546363
  CDS Start-End: 1-2708
ggaaaccccaacagttaatctcggactgcgaaggtcccagcgcgtctgagaacggtgatgctagcgaggaggatcacccccaagtctgtgccaagtgctgcgcacaattcactgacccaactgaattcctcgcccaccagaacgcatgttctactgaccctcctgtaatggtgataattgggggccaggagaaccccaacaactcttcggcctcctctgaaccccggcctgagggtcacaataatcctcaggtcatggacacagagcatagcaaccccccagattctgggtcctccgtgcccacggatcccacctggggcccagagaggagaggagaggagtcttcagggcatttcctggtcgctgccacaggggcagaaacgcccaagcaggccttcttccacctttaccacccactggggtcacagcatcctttctctgctggaggggttgggcgaagccacaaacccacccctgccccttccccagccttgccaggcagcacagatcagctgattgcctcgcctcatctggcattcccaagcaccacgggactactggcagcacagtgtcttggggcagcccgaggccttgaggccactgcctccccagggctcctgaagccaaagaatggaagtggtgagctgagctacggagaagtgatgggtcccttggagaagcctggtggaaggcacaaatgccgcttctgtgccaaagtatttggcagtgacagtgccctgcagatccaccttcgttcccacacgggtgagaggccctataagtgcaatgtctgtggaaaccgttttaccacccgtggcaacctcaaagtgcatttccaccggcatcgtgagaagtacccacatgtgcagatgaacccacacccagtaccagagcacctagactatgtcattaccagcagtggcttgccttatggtatgtccgtgccaccagagaaggccgaggaggaggcagccactccaggtggaggggttgagcgcaagcctctggtggcctccacaacagcactcagtgccacagagagcctgactctgctctccaccagtgcaggcacagccacggctccaggactccctgctttcaataagtttgtgctcatgaaagcagtggaacccaagaataaagctgatgaaaacacccccccagggagtgagggctcagccatcagtggagtggcagaaagtagcacggcaactcgcatgcaactaagtaagttggtgacttcactaccaagctgggcactgcttaccaaccacttcaagtccactggcagcttccccttcccctatgtgctagagcccttgggggcctcaccctctgagacatcaaagctgcagcaactggtagaaaagattgaccggcaaggagctgtggcggtgacctcagctgcctcaggagcccccaccacctctgcccctgcaccttcatcctcagcctcttctggacctaaccagtgtgtcatctgtctccgagtgcttagctgtcctcgggccctacgccttcattatggccaacatggaggtgagaggcccttcaaatgcaaagtgtgtggcagagccttctccaccaggggtaatctgcgtgcacatttcgtgggccacaaggccagtccagctgcccgggcacagaattcctgccccatctgccagaagaagttcaccaatgctgtcactctgcagcagcatgtccggatgcacctggggggccagatccccaacggtggtactgcactccctgaaggtggaggagctgctcaggagaatggctccgagcaatctacagtctccggggcacggagtttcccccagcagcagtcccagcagccatcaccggaagaggagttgtctgaggaggaggaagaggaggatgaggaagaagaggaagatgtgactgatgaagattccctggcagggagaggctcagagagtggaggtgagaaggcaatatcagtgagaggtgattcagaagaggcatctggggcagaggaggaggtggggacagtggcggcagcagccacagctgggaaggagatggacagtaatgagaaaactactcaacagtcttctttgccaccaccaccaccacctgacagcctggatcagcctcagccaatggagcagggaagcagtggtgttttaggaggcaaggaagaggggggcaaaccggagagaagctcaagtccggcatcagcactcaccccagaaggggaagccaccagcgtgaccttggtagaggagctgagcctgcaggaggcaatgagaaaggagccaggagagagcagcagcagaaaggcctgcgaagtgtgtggccaggcctttccctcccaggcagctctggaggagcatcagaagacccaccccaaggaggggccgctcttcacttgtgttttctgcaggcagggctttcttgagcgggctaccctcaagaagcatatgctcctggcacaccaccagaaccagtatgtggcattcctgtcaaatggcctgcccatgaagccctggaattccagctccacctccactaccactccaagcctggccccaccagtgctgtttggcctaggaactgtggctgggaaggtgcctccaacaatgggatccagggaagccaaggagaagacagcccccctcctatttcagcctcctgcacccaaggcagtgcctgagaagcccatcatagacaagaagtagcaaactgtacattccttcttcctccccctgctccagaaggtgccggtactgaagatgctccagtaattggtgacccaaccctaggaagtagggagaaatgaaggaagggcataggaaaattttcccagtaaatcccctgatggtcacattaaggtaaaggttttggctggtcagtgtgccaagacctctccagcttctcattcatgatgacctctcaaagttgggaaacaagctgatttcttgccaagaggtctcccaggagatatttgggaaatgtgaagttcgtatctttaaggagcatttttggtcagcatggttgatgaactaatgatgagagagttaaggaatgttgctagaacatagggcttgctggtacctatgtgact

SEQ ID NO: 185136 - DNA, 1566 bp, Homo sapiens
  Payload ID: 16457
  Gene Symbol: SALL2
  Gene Name: spalt-like transcription factor 2
  ENST ID: ENST00000613414
  CDS Start-End: 14-616
tctctacccgggaatgtctcggcgaaagcagcggaaaccccaacagttaatctcggactgcgaaggtcccagcgcgtctgagaacggtgatgctagcgaggaggatcacccccaagtctgtgccaagtgctgcgcacaattcactgacccaactgaattcctcgcccaccagaacgcatgttctactgaccctcctgtaatggtgataattgggggccaggagaaccccaacaactcttcggcctcctctgaaccccggcctgagggtcacaataatcctcaggtcatggacacagagcatagcaaccccccagattctgggtcctccgtgcccacggatcccacctggggcccagagaggagaggagaggagtcttcagggcatttcctggtcgctgccacagaaccagtatgtggcattcctgtcaaatggcctgcccatgaagccctggaattccagctccacctccactaccactccaagcctggccccaccagtgctgtttggcctaggaactgtggctgggaaggtgcctccaacaatgggatccagggaagccaaggagaagacagcccccctcctatttcagcctcctgcacccaaggcagtgcctgagaagcccatcatagacaagaagtagcaaactgtacattccttcttcctccccctgctccagaaggtgccggtactgaagatgctccagtaattggtgacccaaccctaggaagtagggagaaatgaaggaagggcataggaaaattttcccagtaaatcccctgatggtcacattaaggtaaaggttttggctggtcagtgtgccaagacctctccagcttctcattcatgatgacctctcaaagttgggaaacaagctgatttcttgccaagaggtctcccaggagatatttgggaaatgtgaagttcgtatctttaaggagcatttttggtcagcatggttgatgaactaatgatgagagagttaaggaatgttgctagaacatagggcttgctggtacctatgtgactaagaaagggacatgatgtaagggaaaaggcctcaaattcttgtgaatgtctggacattctcgttaatattcttttgggctaatagtgacatagtgtgcagaggtgtaccagggatcatgggggatttcctagcactagtatgcttctagttttagataactccctcctttattccctggccccttgtattttccttatcttcctctttcaagacccctacccattttgcctatccgtaggctggggcttgtgtctttgtcattgtctggttcttaagagtcccagactttgggagaccagctccaggtggcgtcctccctgcctctccgtcttgtaatgagttgtagtatttactcttaacataggatcatttggaacaggagttctgaggaggagagagtgagggttttgctattgactgacttgaacgatggcttctcctcaagctgtaggctccagagcttcctaacctagtaaaatgtcaagaacagacgggagatattagtgtctttccctctatcattaaaggtgttttaacc

SEQ ID NO: 185137 - DNA, 4942 bp, Homo sapiens
  Payload ID: 16457
  Gene Symbol: SALL2
  Gene Name: spalt-like transcription factor 2
  Uniprot ID: Q9Y467
  ENST ID: ENST00000614342
  CDS Start-End: 296-3319
gcttttacaatgggagctgcagaagcgtagggaagaagctgaagaaaaaaagggggcgtctcccctttaaagacttgcaaagattgagagagaaagagagagagtcaagaacagagaatcagagagagagagagagtctgtgtctctgggaaagaagaacatctctgcttcacagtgatttgcgctgggggagaggcatcaattggcttcggacccaagggggagacgagaccaggtcaccccggttaagaccaagtgagcgttgcccctccctctcccaactctctacccgggaatgtctcggcgaaagcagcggaaaccccaacagttaatctcggactgcgaaggtcccagcgcgtctgagaacggtgatgctagcgaggaggatcacccccaagtctgtgccaagtgctgcgcacaattcactgacccaactgaattcctcgcccaccagaacgcatgttctactgaccctcctgtaatggtgataattgggggccaggagaaccccaacaactcttcggcctcctctgaaccccggcctgagggtcacaataatcctcaggtcatggacacagagcatagcaaccccccagattctgggtcctccgtgcccacggatcccacctggggcccagagaggagaggagaggagtcttcagggcatttcctggtcgctgccacaggtacagcggctgggggaggcgggggcctgatcttggccagtcccaagctgggagcaaccccattacctccagaatcgacccctgcaccccctcctcctccaccaccccctccgcccccaggggtaggcagtggccacttgaatatccccctgatcttggaagagctacgggtgctgcagcagcggcagatccatcagatgcagatgactgagcaaatctgcaggcaggtgctgttgcttggctccttaggccagacggtgggtgcccctgccagtccctcagagctacctgggacagggactgcctcttccaccaagcccctactacccctcttcagccccatcaagcctgtccaaaccagcaagacactggcatcttcctcctcctcctcctcttcctcttcaggggcagaaacgcccaagcaggccttcttccacctttaccacccactggggtcacagcatcctttctctgctggaggggttgggcgaagccacaaacccacccctgccccttccccagccttgccaggcagcacagatcagctgattgcctcgcctcatctggcattcccaagcaccacgggactactggcagcacagtgtcttggggcagcccgaggccttgaggccactgcctccccagggctcctgaagccaaagaatggaagtggtgagctgagctacggagaagtgatgggtcccttggagaagcctggtggaaggcacaaatgccgcttctgtgccaaagtatttggcagtgacagtgccctgcagatccaccttcgttcccacacgggtgagaggccctataagtgcaatgtctgtggaaaccgttttaccacccgtggcaacctcaaagtgcatttccaccggcatcgtgagaagtacccacatgtgcagatgaacccacacccagtaccagagcacctagactatgtcattaccagcagtggcttgccttatggtatgtccgtgccaccagagaaggccgaggaggaggcagccactccaggtggaggggttgagcgcaagcctctggtggcctccacaacagcactcagtgccacagagagcctgactctgctctccaccagtgcaggcacagccacggctccaggactccctgctttcaataagtttgtgctcatgaaagcagtggaacccaagaataaagctgatgaaaacacccccccagggagtgagggctcagccatcagtggagtggcagaaagtagcacggcaactcgcatgcaactaagtaagttggtgacttcactaccaagctgggcactgcttaccaaccacttcaagtccactggcagcttccccttcccctatgtgctagagcccttgggggcctcaccctctgagacatcaaagctgcagcaactggtagaaaagattgaccggcaaggagctgtggcggtgacctcagctgcctcaggagcccccaccacctctgcccctgcaccttcatcctcagcctcttctggacctaaccagtgtgtcatctgtctccgagtgcttagctgtcctcgggccctacgccttcattatggccaacatggaggtgagaggcccttcaaatgcaaagtgtgtggcagagccttctccaccaggggtaatctgcgtgcacatttcgtgggccacaaggccagtccagctgcccgggcacagaattcctgccccatctgccagaagaagttcaccaatgctgtcactctgcagcagcatgtccggatgcacctggggggccagatccccaacggtggtactgcactccctgaaggtggaggagctgctcaggagaatggctccgagcaatctacagtctccggggcacggagtttcccccagcagcagtcccagcagccatcaccggaagaggagttgtctgaggaggaggaagaggaggatgaggaagaagaggaagatgtgactgatgaagattccctggcagggagaggctcagagagtggaggtgagaaggcaatatcagtgagaggtgattcagaagaggcatctggggcagaggaggaggtggggacagtggcggcagcagccacagctgggaaggagatggacagtaatgagaaaactactcaacagtcttctttgccaccaccaccaccacctgacagcctggatcagcctcagccaatggagcagggaagcagtggtgttttaggaggcaaggaagaggggggcaaaccggagagaagctcaagtccggcatcagcactcaccccagaaggggaagccaccagcgtgaccttggtagaggagctgagcctgcaggaggcaatgagaaaggagccaggagagagcagcagcagaaaggcctgcgaagtgtgtggccaggcctttccctcccaggcagctctggaggagcatcagaagacccaccccaaggaggggccgctcttcacttgtgttttctgcaggcagggctttcttgagcgggctaccctcaagaagcatatgctcctggcacaccaccaggtacagccctttgccccccatggccctcagaatattgctgctctttctctagtccctggctgttcgccttccatcacctccacagggctctccccctttccccgaaaagatgaccccacgatcccatgagcctgtttttctgtacctgctgctctttgtcccacagagcagaaacagcttcacaaaaggacctcccagagttatgagccctgattttgtctttttctctaagttcttaacatgttatgtccctagtggcttttctgtagtccctgagcttggaaattactgtgcttacaaggggatggccccctaaggaatttttcttccctcctcattctttgtacctgaggaacatagattctctgcagctttctcaaggggaaccctctccagcttccctggtgtgacccttcttccccctcctctctcctctccctttccctttggtaggtgcacctgagcacctacatttggcattgcagcctagccaaaaagggctggcagctgtctctggagggcccagtgccactcctctggggtgacctttctgctcagctggtgggtatgggtcccctatctttctagaaccagtatgtggcattcctgtcaaatggcctgcccatgaagccctggaattccagctccacctccactaccactccaagcctggccccaccagtgctgtttggcctaggaactgtggctgggaaggtgcctccaacaatgggatccagggaagccaaggagaagacagcccccctcctatttcagcctcctgcacccaaggcagtgcctgagaagcccatcatagacaagaagtagcaaactgtacattccttcttcctccccctgctccagaaggtgccggtactgaagatgctccagtaattggtgacccaaccctaggaagtagggagaaatgaaggaagggcataggaaaattttcccagtaaatcccctgatggtcacattaaggtaaaggttttggctggtcagtgtgccaagacctctccagcttctcattcatgatgacctctcaaagttgggaaacaagctgatttcttgccaagaggtctcccaggagatatttgggaaatgtgaagttcgtatctttaaggagcatttttggtcagcatggttgatgaactaatgatgagagagttaaggaatgttgctagaacatagggcttgctggtacctatgtgactaagaaagggacatgatgtaagggaaaaggcctcaaattcttgtgaatgtctggacattctcgttaatattcttttgggctaatagtgacatagtgtgcagaggtgtaccagggatcatgggggatttcctagcactagtatgcttctagttttagataactccctcctttattccctggccccttgtattttccttatcttcctctttcaagacccctacccattttgcctatccgtaggctggggcttgtgtctttgtcattgtctggttcttaagagtcccagactttgggagaccagctccaggtggcgtcctccctgcctctccgtcttgtaatgagttgtagtatttactcttaacataggatcatttggaacaggagttctgaggaggagagagtgagggttttgctattgactgacttgaacgatggcttctcctcaagctgtaggctccagagcttcctaacctagtaaaatgtcaagaacagacgggagatattagtgtctttccctctatcattaaaggtgttttaaccaa

SEQ ID NO: 185138 - DNA, 1466 bp, Homo sapiens
  Payload ID: 16457
  Gene Symbol: SALL2
  Gene Name: spalt-like transcription factor 2
  ENST ID: ENST00000611430
  CDS Start-End: 374-970
acagcacctgtcactgcgcctccggaaactctcccgagctctgagctcccgcccccacgcccccgctagcgctcccttctcccgcctcctctagctcccgcctccctccccagcagctcctccccataaactcccctcctcatcagctcctcccagatctcccctctccccgctttctcactccagcttctccccgcctcctcgctcccctccccctccgccgctgctccctgcccccgccgctgccgatctccatctccgcagtctgggccgctgggtgcagaggctgccgcagacccagcggccatcgcctccctcaatcccaatatccattgtctcccaccccacctggccctccacttcccccacaaccatggcgcacgaatccgagaggagctctcgtctcggggtgccctgcggggagccggcagagctcggaggtgatgctagcgaggaggatcacccccaagtctgtgccaagtgctgcgcacaattcactgacccaactgaattcctcgcccaccagaacgcatgttctactgaccctcctgtaatggtgataattgggggccaggagaaccccaacaactcttcggcctcctctgaaccccggcctgagggtcacaataatcctcaggtcatggacacagagcatagcaaccccccagattctgggtcctccgtgcccacggatcccacctggggcccagagaggagaggagaggagtcttcagggcatttcctggtcgctgccacagaaccagtatgtggcattcctgtcaaatggcctgcccatgaagccctggaattccagctccacctccactaccactccaagcctggccccaccagtgctgtttggcctaggaactgtggctgggaaggtgcctccaacaatgggatccagggaagccaaggagaagacagcccccctcctatttcagcctcctgcacccaaggcagtgcctgagaagcccatcatagacaagaagtagcaaactgtacattccttcttcctccccctgctccagaaggtgccggtactgaagatgctccagtaattggtgacccaaccctaggaagtagggagaaatgaaggaagggcataggaaaattttcccagtaaatcccctgatggtcacattaaggtaaaggttttggctggtcagtgtgccaagacctctccagcttctcattcatgatgacctctcaaagttgggaaacaagctgatttcttgccaagaggtctcccaggagatatttgggaaatgtgaagttcgtatctttaaggagcatttttggtcagcatggttgatgaactaatgatgagagagttaaggaatgttgctagaacatagggcttgctggtacctatgtgactaagaaagggacatgatgtaagggaaaaggcctcaaattcttgtgaatgtctggacattctcgttaatattcttttgggctaatag

SEQ ID NO: 185139 - DNA, 3997 bp, Homo sapiens
  Payload ID: 16458
  Gene Symbol: SALL3
  Gene Name: spalt-like transcription factor 3
  Uniprot ID: Q9BXA9
  ENST ID: ENST00000536229
  CDS Start-End: 710-3997
tgttaagtgaactggcaaaggcatctctaattttgctggaaatgaggaagccggatggtaaaggggaatcctaatgagcccatcgaaagccggctttgtactcaacagacagggtagccgcagattgtatgaaaatattggaaatcaatggcttctatggaatttcattaagaagcaggatccacaattgatagggcctcataatttgatggattgggctaagaaaatgattagctagctagaaagagtcatagaatacgcacgctgggacgtcagaaatgtcgaagtggggtaatttgtacaaaataaaaaatattgattttactcgtgcaaaattttgagacggagggcgggcgccgagccccggctgactcactctcttggtcttgcagccgccccgggggaaggtgcggaggacgcagacagcgggcccgagagccgcagcgggggcgaggagaccagcgtgtgcgagaaatgctgcgccgagttcttcaagtgggcggacttcctggagcaccagcggagctgcaccaagctcccgcccgtgctgatcgtgcacgaggacgcgcccgcgccgccccccgaggacttccccgagccttcgcccgccagctcccccagcgagcgcgccgaaagcgaggcggccgaggaggcgggtgcggagggcgcggagggcgaggccaggccggtggagaaggaggccgagcccatggacgcggaacccgcgggggacacgcgcgcgccccggcccccgcctgcggcccctgcacccccaacgcccgcctacggcgcgcccagcaccaacgtgaccctggaggcgctgctgagcaccaaggtggcggtggcgcagttctcgcagggcgcgcgcgcggcaggcggctcgggagcaggtggaggcgtggcagctgcagccgtgcccctgatcctggaacagctcatggccctgcagcagcagcagatccaccagctgcagctcatcgagcagatccgcagccaggtggccctcatgcagcgcccgccgccgcggccctcactcagccccgcggccgccccgagcgcaccgggcccggcccccagccagctgcccgggctggccgcgctcccgctgtcggccggggcccctgccgccgccatcgcgggctcgggccccgccgccccggccgccttcgagggcgcgcagccgctgtcccggcccgagtctggcgccagcacccccggcggccctgcggagcccagcgcgcccgccgcccccagcgccgcccctgcccccgctgcccccgccccggcgccagcgccgcagagcgcagcctcgtcgcagccgcagagcgcatccacgccgcctgccctggccccggggtccctgctgggtgcggcgcccggcctgccaagtccgcttctacctcagacttccgccagcggcgtcatcttccccaacccgctggtcagcatcgcggccacggccaacgctctggacccgctgtccgcgctcatgaagcaccgcaagggcaagccgcccaatgtgtcggtgttcgagcccaaagccagcgccgaggacccgttcttcaagcacaaatgccgcttctgcgccaaggtcttcggcagcgacagcgcgctccagatccacctgcgctcgcacacaggcgagcggcccttcaagtgcaacatctgcgggaaccgcttctccaccaaaggcaacctgaaggtgcacttccagaggcacaaggagaagtacccccacatccagatgaacccttacccggtccccgagtacctggacaacgtgcccacctgctcgggcatcccctacggcatgtcgctgccccccgagaagcccgtgaccacctggctggacagcaagcccgtgctgcccaccgtgcccacgtccgtggggctgcaactgccgcccactgtccctggcgcgcacggctacgccgactctcccagcgccaccccagccagccgctccccgcagaggccctcgcccgcctccagcgagtgcgcctccttgtccccaggcctcaaccacgtggagtccggcgtgtcggccaccgccgagtccccacagtcgctcctcggcgggccgcccctcactaaagccgagcccgtcagcctgccctgcaccaacgccagggccggggacgctcccgtgggcgcgcaggctagcgctgcacccacatcggtggacggcgcacccacgagcctcggcagccccgggctgcccgccgtctccgagcagttcaaggcccagtttccgttcggggggctgctagactcgatgcaaacgtcggaaacctcgaagctgcagcagctggtggagaacatcgacaagaagatgacggacccgaaccagtgcgtcatctgccaccgggtgctgagctgccagagcgcgctgaagatgcactaccggacgcacacgggggagcggccgttcaagtgcaagatctgcggccgcgccttcaccaccaagggcaacctcaagacgcacttcggcgtgcaccgtgcaaagccgcccctgcgcgtgcagcactcctgccccatctgccagaagaagttcaccaacgccgtggtcctgcagcagcacatccgcatgcacatgggcggccagatccccaacacgccgctgccggagggcttccaggatgccatggactccgagctggcctacgacgacaagaacgcggagaccctgagcagctacgatgacgacatggacgagaactccatggaggacgacgctgagctgaaggacgcggccaccgacccggccaagccactcctgtcctacgcggggtcctgcccgccctccccgccctcggtcatctccagcattgccgccctggagaaccagatgaagatgatcgactcggtcatgagctgccagcagctgaccggcctcaagtccgtggagaacgggtccggggagagtgaccgcctgagcaacgactcctcgtcggccgtgggcgacctggagagccgcagcgcgggcagccccgccctgtccgagtcctcgtcctcgcaggccctgtcgccggcccccagcaatggtgagagcttccgctccaagtccccgggcctgggcgccccggaggagccccaggaaatcccgctcaagaccgagaggccggacagcccagccgccgccccgggcagcggaggcgcccctggccgcgcgggcatcaaggaggaggcgcccttcagcctgctgttcctgagcagggagcggggtcccagccaaagcactcctagcctgatctccagcgccgcacccaccatgatcaaaatggaagtgaacggtcacggcaaggccatggcgctgggcgagggtcccccgctgcccgcgggcgtccaggtccccgccgggcctcagacagtgatgggcccgggcctggcgcccatgctggcccccccaccgcgccggacgcccaagcagcacaactgccagtcgtgcgggaagaccttctcctcggccagcgccctgcagatccatgagcgcacgcacaccggcgagaagccgttcggctgcaccatctgcggccgggccttcaccactaagggcaacctcaaggtgcacatggggacacacatgtggaataacgcccccgcgagacgcggccgccgcctgtctgtggagaaccccatggctctcctagggggtgatgccctgaagttctctgaaatgttccagaaggacctggcagctcgggcaatgaacgtcgaccccagtttttggaaccagtatgctgcagccatcactaacgggctcgccatgaagaacaacgagatctccgtcatccagaacggcggcatcccccagctccccgtgagtcttgggggcagcgccctcccccctctgggcagcatggccagtgggatggacaaagcacgcactggcagtagcccacccatcgtcagcttggacaaagcgagctcagaaacagcagccagccgcccattcacgcggtttatcgaggataacaaggagattggtatcaactag

SEQ ID NO: 185140 - DNA, 6555 bp, Homo sapiens
  Payload ID: 16458
  Gene Symbol: SALL3
  Gene Name: spalt-like transcription factor 3
  Uniprot ID: Q9BXA9
  ENST ID: ENST00000537592
  CDS Start-End: 1-3903
atgtctcggcgcaagcaggccaagccccagcacctcaagtcggacgaggagctgctgccgcctgacggggctcccgagcacgccgccccgggggaaggtgcggaggacgcagacagcgggcccgagagccgcagcgggggcgaggagaccagcgtgtgcgagaaatgctgcgccgagttcttcaagtgggcggacttcctggagcaccagcggagctgcaccaagctcccgcccgtgctgatcgtgcacgaggacgcgcccgcgccgccccccgaggacttccccgagccttcgcccgccagctcccccagcgagcgcgccgaaagcgaggcggccgaggaggcgggtgcggagggcgcggagggcgaggccaggccggtggagaaggaggccgagcccatggacgcggaacccgcgggggacacgcgcgcgccccggcccccgcctgcggcccctgcacccccaacgcccgcctacggcgcgcccagcaccaacgtgaccctggaggcgctgctgagcaccaaggtggcggtggcgcagttctcgcagggcgcgcgcgcggcaggcggctcgggagcaggtggaggcgtggcagctgcagccgtgcccctgatcctggaacagctcatggccctgcagcagcagcagatccaccagctgcagctcatcgagcagatccgcagccaggtggccctcatgcagcgcccgccgccgcggccctcactcagccccgcggccgccccgagcgcaccgggcccggcccccagccagctgcccgggctggccgcgctcccgctgtcggccggggcccctgccgccgccatcgcgggctcgggccccgccgccccggccgccttcgagggcgcgcagccgctgtcccggcccgagtctggcgccagcacccccggcggccctgcggagcccagcgcgcccgccgcccccagcgccgcccctgcccccgctgcccccgccccggcgccagcgccgcagagcgcagcctcgtcgcagccgcagagcgcatccacgccgcctgccctggccccggggtccctgctgggtgcggcgcccggcctgccaagtccgcttctacctcagacttccgccagcggcgtcatcttccccaacccgctggtcagcatcgcggccacggccaacgctctggacccgctgtccgcgctcatgaagcaccgcaagggcaagccgcccaatgtgtcggtgttcgagcccaaagccagcgccgaggacccgttcttcaagcacaaatgccgcttctgcgccaaggtcttcggcagcgacagcgcgctccagatccacctgcgctcgcacacaggcgagcggcccttcaagtgcaacatctgcgggaaccgcttctccaccaaaggcaacctgaaggtgcacttccagaggcacaaggagaagtacccccacatccagatgaacccttacccggtccccgagtacctggacaacgtgcccacctgctcgggcatcccctacggcatgtcgctgccccccgagaagcccgtgaccacctggctggacagcaagcccgtgctgcccaccgtgcccacgtccgtggggctgcaactgccgcccactgtccctggcgcgcacggctacgccgactctcccagcgccaccccagccagccgctccccgcagaggccctcgcccgcctccagcgagtgcgcctccttgtccccaggcctcaaccacgtggagtccggcgtgtcggccaccgccgagtccccacagtcgctcctcggcgggccgcccctcactaaagccgagcccgtcagcctgccctgcaccaacgccagggccggggacgctcccgtgggcgcgcaggctagcgctgcacccacatcggtggacggcgcacccacgagcctcggcagccccgggctgcccgccgtctccgagcagttcaaggcccagtttccgttcggggggctgctagactcgatgcaaacgtcggaaacctcgaagctgcagcagctggtggagaacatcgacaagaagatgacggacccgaaccagtgcgtcatctgccaccgggtgctgagctgccagagcgcgctgaagatgcactaccggacgcacacgggggagcggccgttcaagtgcaagatctgcggccgcgccttcaccaccaagggcaacctcaagacgcacttcggcgtgcaccgtgcaaagccgcccctgcgcgtgcagcactcctgccccatctgccagaagaagttcaccaacgccgtggtcctgcagcagcacatccgcatgcacatgggcggccagatccccaacacgccgctgccggagggcttccaggatgccatggactccgagctggcctacgacgacaagaacgcggagaccctgagcagctacgatgacgacatggacgagaactccatggaggacgacgctgagctgaaggacgcggccaccgacccggccaagccactcctgtcctacgcggggtcctgcccgccctccccgccctcggtcatctccagcattgccgccctggagaaccagatgaagatgatcgactcggtcatgagctgccagcagctgaccggcctcaagtccgtggagaacgggtccggggagagtgaccgcctgagcaacgactcctcgtcggccgtgggcgacctggagagccgcagcgcgggcagccccgccctgtccgagtcctcgtcctcgcaggccctgtcgccggcccccagcaatggtgagagcttccgctccaagtccccgggcctgggcgccccggaggagccccaggaaatcccgctcaagaccgagaggccggacagcccagccgccgccccgggcagcggaggcgcccctggccgcgcgggcatcaaggaggaggcgcccttcagcctgctgttcctgagcagggagcggggtaagtgtcccagcactgtgtgtggtgtctgtggcaagccttttgcttgcaagagcgcgttggaaatccactaccgcagccatactaaggagcggccattcgtctgcgcgctctgcaggcgagggtgctccactatgggtaatttaaaacagcacttactgacacacagattgaaagagctgccttctcagttatttgaccccaactttgctctaggtcccagccaaagcactcctagcctgatctccagcgccgcacccaccatgatcaaaatggaagtgaacggtcacggcaaggccatggcgctgggcgagggtcccccgctgcccgcgggcgtccaggtccccgccgggcctcagacagtgatgggcccgggcctggcgcccatgctggcccccccaccgcgccggacgcccaagcagcacaactgccagtcgtgcgggaagaccttctcctcggccagcgccctgcagatccatgagcgcacgcacaccggcgagaagccgttcggctgcaccatctgcggccgggccttcaccactaagggcaacctcaaggtgcacatggggacacacatgtggaataacgcccccgcgagacgcggccgccgcctgtctgtggagaaccccatggctctcctagggggtgatgccctgaagttctctgaaatgttccagaaggacctggcagctcgggcaatgaacgtcgaccccagtttttggaaccagtatgctgcagccatcactaacgggctcgccatgaagaacaacgagatctccgtcatccagaacggcggcatcccccagctccccgtgagtcttgggggcagcgccctcccccctctgggcagcatggccagtgggatggacaaagcacgcactggcagtagcccacccatcgtcagcttggacaaagcgagctcagaaacagcagccagccgcccattcacgcggtttatcgaggataacaaggagattggtatcaactagccagtgactcgctcatctgccctgcccaggcccacgttttgaagttggagcatcaggcctccgacctttcttgcctcggttctcattacactttcacccatagcagaaaacactttgtgcggctgccgagaggtggtcttgtaagcgctgcatggcgctcccttcaacagcaagcctgactgttctcgagaactctgcaatcttttaaataagcttccttcaaaaaaaaaagtgcttggaaaaccgccttaggaacagaaagagctcagaccatgtccacttcctttctcctgaaacctaataatctctccgagggagaaaggggttctctgcggtattccagtgaaactcatttgatggtttcttttgaattagttagacacttgaacggtgttttttagaactcttcatgttaaagacgtggtttagtactcccaatgctgtgtatcatgacactatcttcgtctgtagtatttatgatgttaagataatgcgggtaacagacaatataatagccccgaccttaaacgaagcttttgtactgcagaatacatctggctgtgtgatttttttttttaagcaagatttgttttactataaataagtggattatttcaatgcaggcaaaattgtgaagttctgttgggaaagatagcatgcttttcgtgtgcaagtacctgtcagtaataagccttttttttttttttttttaatttaaatgtttgtagctgctatgtggacagttgttttctagtgtggtctgtagcccaataactggggaacgagttacagacaaacatcaccgtaaatgactcacaacattataaacagttgtgagaaaatatttcacattatcaaagctgtacaataaaaaggtaatgtttgtataatgtggttgcaaactcttaatttatactattgcacttttagtattttgtattagggaggtttgtctataatttgaaaatttaaaaaaatgtaaagtattttataaatagtacttcagtttaaggaaaatgggaaaactgttacagttccttgttttgtcttatggtcaaacaatattagaaatctctgccacttgaaaagccaccaagacttgtcagcttttcagtaaagtagggcctgccgtttcttaaattaaaatgatttatttaacttttccacaaagcccactttaaaactgtgaccgccccctaacgaaaccttggtgaattcatcctaggactatgacgtcagtacaagccaggaaggaactaggataaccttctgcaggtctgattttcatgtaagcgggtctgtctctctctctcacccacagacaagattgtggctgcctggtggcactggtcacatgtacagtaaacccaagagaaatggcaagtatcaggcagtacaatcagtcatgactttgaaattttccgagttcctgatttatttattatcttctcagatgaaagcaaagcacagtgtcctctgatttttcagaacacagcctgacgctgatggctgagctgcatccagccaggagggccccggaggctggggcggccgaggcagcacaaacacggcgtcgtgaactacctcattttcgtgcgttgcaagtgtgctggcgtctgacactatgaacttccaacaacaaaattgttcaagagatgctctggtagctgggtaactgcaaggagttgcatgcccctgaagaaagaatcagacagtgaagtcttctcggtcgagacagaaaaatagaacaatcttctcctaacaaccacagcagcatcaacaatcattgtaagaggatgggctgtttgtgccagcgtgtcactaaacaaaaagtatcaaagactcattagctgtttatttctattggaaatcaacactgaactctacagctctgttttccacggtgatgagatgtaacttcgccccaccatgccacctcttctcacgggatgagggctcggggtgtctcaagcattaggcagagaaaactgaggtggcttaaggtcactgtgtttcagcagttgaatgttttcattatttatctgtgtcctttttggtgtgtgtgtgtgtgtggtttttttgtttgtttgtttttggttagtatttggtaccatatagtgttctctcttctcccaaaaggatgtgtatataactaaagagaaatgtaaagtgttgtaaataagatggctcatgaaggtacagtgagactgaccctcctgtgtgcagggctaggccatccctctgcatggtgaagagagacactatttttatactgtaatgccatgcggggctgggacctctctgagcagctggggattgttacctagacccaatattttttattattaaatcttgtggcttgacacatctgctgactgaaatggatgtcttagtctaggttactatttttgtcatatggaattgaataaaatgcaggatgtaatgttatttctgagttgcattccttgatttttctaatggagaaagtggaatttgaggaggtcatttgtggtgggtgtgtatccgtggtatttccaccaggaacgtcaacacagcttggcagcttagatttaagcagtgtctcagtgcatcttgattggtcttgaaatttttgttttttgcttttttccaaaataaaaattcagcctccta

SEQ ID NO: 185141 - DNA, 3996 bp, Homo sapiens
  Payload ID: 16458
  Gene Symbol: SALL3
  Gene Name: spalt-like transcription factor 3
  Uniprot ID: Q9BXA9
  ENST ID: ENST00000575389
  CDS Start-End: 1-3687
atgtctcggcgcaagcaggccaagccccagcacctcaagtcggacgaggagctgctgccgcctgacggggctcccgagcacgccgccccgggggaaggtgcggaggacgcagacagcgggcccgagagccgcagcgggggcgaggagaccagcgtgtgcgagaaatgctgcgccgagttcttcaagtgggcggacttcctggagcaccagcggagctgcaccaagctcccgcccgtgctgatcgtgcacgaggacgcgcccgcgccgccccccgaggacttccccgagccttcgcccgccagctcccccagcgagcgcgccgaaagcgaggcggccgaggaggcgggtgcggagggcgcggagggcgaggccaggccggtggagaaggaggccgagcccatggacgcggaacccgcgggggacacgcgcgcgccccggcccccgcctgcggcccctgcacccccaacgcccgcctacggcgcgcccagcaccaacgtgaccctggaggcgctgctgagcaccaaggtggcggtggcgcagttctcgcagggcgcgcgcgcggcaggcggctcgggagcaggtggaggcgtggcagctgcagccgtgcccctgatcctggaacagctcatggccctgcagcagcagcagatccaccagctgcagctcatcgagcagatccgcagccaggtggccctcatgcagcgcccgccgccgcggccctcactcagccccgcggccgccccgagcgcaccgggcccggcccccagccagctgcccgggctggccgcgctcccgctgtcggccggggcccctgccgccgccatcgcgggctcgggccccgccgccccggccgccttcgagggcgcgcagccgctgtcccggcccgagtctggcgccagcacccccggcggccctgcggagcccagcgcgcccgccgcccccagcgccgcccctgcccccgctgcccccgccccggcgccagcgccgcagagcgcagcctcgtcgcagccgcagagcgcatccacgccgcctgccctggccccggggtccctgctgggtgcggcgcccggcctgccaagtccgcttctacctcagacttccgccagcggcgtcatcttccccaacccgctggtcagcatcgcggccacggccaacgctctggacccgctgtccgcgctcatgaagcaccgcaagggcaagccgcccaatgtgtcggtgttcgagcccaaagccagcgccgaggacccgttcttcaagcacaaatgccgcttctgcgccaaggtcttcggcagcgacagcgcgctccagatccacctgcgctcgcacacaggcgagcggcccttcaagtgcaacatctgcgggaaccgcttctccaccaaaggcaacctgaaggtgcacttccagaggcacaaggagaagtacccccacatccagatgaacccttacccggtccccgagtacctggacaacgtgcccacctgctcgggcatcccctacggcatgtcgctgccccccgagaagcccgtgaccacctggctggacagcaagcccgtgctgcccaccgtgcccacgtccgtggggctgcaactgccgcccactgtccctggcgcgcacggctacgccgactctcccagcgccaccccagccagccgctccccgcagaggccctcgcccgcctccagcgagtgcgcctccttgtccccaggcctcaaccacgtggagtccggcgtgtcggccaccgccgagtccccacagtcgctcctcggcgggccgcccctcactaaagccgagcccgtcagcctgccctgcaccaacgccagggccggggacgctcccgtgggcgcgcaggctagcgctgcacccacatcggtggacggcgcacccacgagcctcggcagccccgggctgcccgccgtctccgagcagttcaaggcccagtttccgttcggggggctgctagactcgatgcaaacgtcggaaacctcgaagctgcagcagctggtggagaacatcgacaagaagatgacggacccgaaccagtgcgtcatctgccaccgggtgctgagctgccagagcgcgctgaagatgcactaccggacgcacacgggggagcggccgttcaagtgcaagatctgcggccgcgccttcaccaccaagggcaacctcaagacgcacttcggcgtgcaccgtgcaaagccgcccctgcgcgtgcagcactcctgccccatctgccagaagaagttcaccaacgccgtggtcctgcagcagcacatccgcatgcacatgggcggccagatccccaacacgccgctgccggagggcttccaggatgccatggactccgagctggcctacgacgacaagaacgcggagaccctgagcagctacgatgacgacatggacgagaactccatggaggacgacgctgagctgaaggacgcggccaccgacccggccaagccactcctgtcctacgcggggtcctgcccgccctccccgccctcggtcatctccagcattgccgccctggagaaccagatgaagatgatcgactcggtcatgagctgccagcagctgaccggcctcaagtccgtggagaacgggtccggggagagtgaccgcctgagcaacgactcctcgtcggccgtgggcgacctggagagccgcagcgcgggcagccccgccctgtccgagtcctcgtcctcgcaggccctgtcgccggcccccagcaatggtgagagcttccgctccaagtccccgggcctgggcgccccggaggagccccaggaaatcccgctcaagaccgagaggccggacagcccagccgccgccccgggcagcggaggcgcccctggccgcgcgggcatcaaggaggaggcgcccttcagcctgctgttcctgagcagggagcggggtcccagccaaagcactcctagcctgatctccagcgccgcacccaccatgatcaaaatggaagtgaacggtcacggcaaggccatggcgctgggcgagggtcccccgctgcccgcgggcgtccaggtccccgccgggcctcagacagtgatgggcccgggcctggcgcccatgctggcccccccaccgcgccggacgcccaagcagcacaactgccagtcgtgcgggaagaccttctcctcggccagcgccctgcagatccatgagcgcacgcacaccggcgagaagccgttcggctgcaccatctgcggccgggccttcaccactaagggcaacctcaaggtgcacatggggacacacatgtggaataacgcccccgcgagacgcggccgccgcctgtctgtggagaaccccatggctctcctagggggtgatgccctgaagttctctgaaatgttccagaaggacctggcagctcgggcaatgaacgtcgaccccagtttttggaaccagtatgctgcagccatcactaacgggctcgccatgaagaacaacgagatctccgtcatccagaacggcggcatcccccagctccccgtgagtcttgggggcagcgccctcccccctctgggcagcatggccagtgggatggacaaagcacgcactggcagtagcccacccatcgtcagcttggacaaagcgagctcagaaacagcagccagccgcccattcacgcggtttatcgaggataacaaggagattggtatcaactagccagtgactcgctcatctgccctgcccaggcccacgttttgaagttggagcatcaggcctccgacctttcttgcctcggttctcattacactttcacccatagcagaaaacactttgtgcggctgccgagaggtggtcttgtaagcgctgcatggcgctcccttcaacagcaagcctgactgttctcgagaactctgcaatcttttaaataagcttccttcaaaaaaaaaagtgcttggaaaaccgccttaggaacagaaagagctcagaccatgtccacttcctttctcctgaaacctaataatctct

SEQ ID NO: 185142 - DNA, 3916 bp, Homo sapiens
  Payload ID: 16458
  Gene Symbol: SALL3
  Gene Name: spalt-like transcription factor 3
  ENST ID: ENST00000572106
  CDS Start-End: 1-3673
gcaggccaagccccagcacctcaagtcggacgaggagctgctgccgcctgacggggctcccgagcacgccgccccgggggaaggtgcggaggacgcagacagcgggcccgagagccgcagcgggggcgaggagaccagcgtgtgcgagaaatgctgcgccgagttcttcaagtgggcggacttcctggagcaccagcggagctgcaccaagctcccgcccgtgctgatcgtgcacgaggacgcgcccgcgccgccccccgaggacttccccgagccttcgcccgccagctcccccagcgagcgcgccgaaagcgaggcggccgaggaggcgggtgcggagggcgcggagggcgaggccaggccggtggagaaggaggccgagcccatggacgcggaacccgcgggggacacgcgcgcgccccggcccccgcctgcggcccctgcacccccaacgcccgcctacggcgcgcccagcaccaacgtgaccctggaggcgctgctgagcaccaaggtggcggtggcgcagttctcgcagggcgcgcgcgcggcaggcggctcgggagcaggtggaggcgtggcagctgcagccgtgcccctgatcctggaacagctcatggccctgcagcagcagcagatccaccagctgcagctcatcgagcagatccgcagccaggtggccctcatgcagcgcccgccgccgcggccctcactcagccccgcggccgccccgagcgcaccgggcccggcccccagccagctgcccgggctggccgcgctcccgctgtcggccggggcccctgccgccgccatcgcgggctcgggccccgccgccccggccgccttcgagggcgcgcagccgctgtcccggcccgagtctggcgccagcacccccggcggccctgcggagcccagcgcgcccgccgcccccagcgccgcccctgcccccgctgcccccgccccggcgccagcgccgcagagcgcagcctcgtcgcagccgcagagcgcatccacgccgcctgccctggccccggggtccctgctgggtgcggcgcccggcctgccaagtccgcttctacctcagacttccgccagcggcgtcatcttccccaacccgctggtcagcatcgcggccacggccaacgctctggacccgctgtccgcgctcatgaagcaccgcaagggcaagccgcccaatgtgtcggtgttcgagcccaaagccagcgccgaggacccgttcttcaagcacaaatgccgcttctgcgccaaggtcttcggcagcgacagcgcgctccagatccacctgcgctcgcacacaggcgagcggcccttcaagtgcaacatctgcgggaaccgcttctccaccaaaggcaacctgaaggtgcacttccagaggcacaaggagaagtacccccacatccagatgaacccttacccggtccccgagtacctggacaacgtgcccacctgctcgggcatcccctacggcatgtcgctgccccccgagaagcccgtgaccacctggctggacagcaagcccgtgctgcccaccgtgcccacgtccgtggggctgcaactgccgcccgctgtccctggcgcgcacggctacgccgactctcccagcgccaccccagccagccgctccccgcagaggccctcgcccgcctccagcgagtgcgcctccttgtccccaggcctcaaccacgtggagtccggcgtgtcggccaccgccgagtccccacagtcgctcctcggcgggccgcccgtcactaaagccgagcccgtcagcctgccctgcaccaacgccagggccggggacgctcccgtgggcgcgcaggctagcgctgcacccacatcggtggacggcgcacccacgagcctcggcagccccgggctgcccgccgtctccgagcagttcaaggcccagtttccgttcggggggctgctagactcgatgcaaacgtcggaaacctcgaagctgcagcagctggtggagaacatcgacaagaagatgacggacccgaaccagtgcgtcatctgccaccgggtgctgagctgccagagcgcgctgaagatgcactaccggacgcacacgggggagcggccgttcaagtgcaagatctgcggccgcgccttcaccaccaagggcaacctcaagacgcacttcggcgtgcaccgtgcaaagccgcccctgcgcgtgcagcactcctgccccatctgccagaagaagttcaccaacgccgtggtcctgcagcagcacatccgcatgcacatgggcggccagatccccaacacgccgctgccggagggcttccaggatgccatggactccgagctggcctacgacgacaagaacgcggagaccctgagcagctacgatgacgacatggacgagaactccatggaggacgacgctgagctgaaggacgcggccaccgacccggccaagccactcctgtcctatgcggggtcctgcccgccctccccgccctcggtcatctccagcattgccgccctggagaaccagatgaagatgatcgactcggtcatgagctgccagcagctgaccggcctcaagtccgtggagaacgggtccggggagagtgaccgcctgagcaacgactcctcgtcggccgtgggcgacctggagagccgcagcgcgggcagccccgccctgtccgagtcctcgtcctcgcaggccctgtcgccggcccccagcaatggtgagagcttccgctccaagtccccgggcctgggcgccccggaggagccccaggaaatcccgctcaagaccgagaggccggacagcccagccgccgccccgggcagcggaggcgcccctggccgcgcgggcatcaaggaggaggcgcccttcagcctgctgttcctgagcagggagcggggtcccagccaaagcactcctagcctgatctccagcgccgcacccaccatgatcaaaatggaagtgaacggtcacggcaaggccatggcgctgggcgagggtcccccgctgcccgcgggcgtccaggtccccgccgggcctcagacagtgatgggcccgggcctggcgcccatgctggcccccccaccgcgccggacgcccaagcagcacaactgccagtcgtgcgggaagaccttctcctcggccagcgccctgcagatccatgagcgcacgcacaccggcgagaagccgttcggctgcaccatctgcggccgggccttcaccactaagggcaacctcaaggtgcacatggggacacacatgtggaataacgcccccgcgagacgcggccgccgcctgtctgtggagaaccccatggctctcctagggggtgatgccctgaagttctctgaaatgttccagaaggacctggcagctcgggcaatgaacgtcgaccccagtttttggaaccagtatgctgcagccatcactaacgggctcgccatgaagaacaacgagatctccgtcatccagaacggcggcatcccccagctccccgtgagtcttgggggcagcgccctcccccctctgggcagcatggccagtgggatggacaaagcacgcactggcagtagcccacccatcgtcagcttggacaaagcgagctcagaaacagcagccagccgcccattcacgcggtttatcgaggataacaaggagattggtatcaactagccagtgactcgctcatctgccctgcccaggcccacgttttgaagttggagcatcaggcctccgacctttcttgcctcggttctcattacactttcacccatagcagaaaacactttgtgcggctgccgagaggtggtcttgtaagcgctgcatggcgctcccttcaacagcaagcctgactgttctcgagaactctgcaatcttttaaataagcttccttcaaaaaaaaaagtgcttggaaaa

SEQ ID NO: 185143 - DNA, 838 bp, Homo sapiens
  Payload ID: 16458
  Gene Symbol: SALL3
  Gene Name: spalt-like transcription factor 3
  ENST ID: ENST00000573592
  CDS Start-End: 1-452
agaggccggacagcccagccgccgccccgggcagcggaggcgcccctggccgcgcgggcatcaaggaggaggcgcccttcagcctgctgttcctgagcagggagcggggtcccagccaaagcactcctagcctgatctccagcgccgcacccaccatgatcaaaatggaagtgaacggtcacggcaaggccatggcgctgggcgagggtcccccgctgcccgcgggcgtccaggtccccgccgggcctcagacagtgatgggcccgggcctggcgcccatgctggcccccccaccgcgccggacgcccaagcagcacaactgccagtcgtgcgggaagaccttctcctcggccagcgccctgcagatccatgagcgcacgcacaccggcgagaagccgttcggctgcaccatctgcggccgggccttcaccactaagggcaacctcaagtagaatatcagagagcctaaactatgaacattggtgttactgtcctgatttctaccaccgtctgcatctttggcctgttttcattggaagtatcatagattgtcatttggacagaccattcctagcgaatactggcctttcgcggagcttggaaaaccctgtgggaaaatcagaaagctggtaagataagaggaagaagagatgtcacggtgtcagattatgtttgtattctgttctgtccaaagttctttacatcagtaaatgaaaaacaaaacaaatgatgcataggccacgccctgcagtgaaagatgcaagaacttgttcatattggtatgaatcgttcactgtatatgattcaaacatgtggaaataaatgtttgattacagtc

SEQ ID NO: 185144 - DNA, 3903 bp, Homo sapiens
  Payload ID: 16458
  Gene Symbol: SALL3
  Gene Name: spalt-like transcription factor 3
  ENST ID: ENST00000576809
  CDS Start-End: 1-3903
atgtctcggcgcaagcaggccaagccccagcacctcaagtcggacgaggagctgctgccgcctgacggggctcccgagcacgccgccccgggggaaggtgcggaggacgcagacagcgggcccgagagccgcagcgggggcgaggagaccagcgtgtgcgagaaatgctgcgccgagttcttcaagtgggcggacttcctggagcaccagcggagctgcaccaagctcccgcccgtgctgatcgtgcacgaggacgcgcccgcgccgccccccgaggacttccccgagccttcgcccgccagctcccccagcgagcgcgccgaaagcgaggcggccgaggaggcgggtgcggagggcgcggagggcgaggccaggccggtggagaaggaggccgagcccatggacgcggaacccgcgggggacacgcgcgcgccccggcccccgcctgcggcccctgcacccccaacgcccgcctacggcgcgcccagcaccaacgtgaccctggaggcgctgctgagcaccaaggtggcggtggcgcagttctcgcagggcgcgcgcgcggcaggcggctcgggagcaggtggaggcgtggcagctgcagccgtgcccctgatcctggaacagctcatggccctgcagcagcagcagatccaccagctgcagctcatcgagcagatccgcagccaggtggccctcatgcagcgcccgccgccgcggccctcactcagccccgcggccgccccgagcgcaccgggcccggcccccagccagctgcccgggctggccgcgctcccgctgtcggccggggcccctgccgccgccatcgcgggctcgggccccgccgccccggccgccttcgagggcgcgcagccgctgtcccggcccgagtctggcgccagcacccccggcggccctgcggagcccagcgcgcccgccgcccccagcgccgcccctgcccccgctgcccccgccccggcgccagcgccgcagagcgcagcctcgtcgcagccgcagagcgcatccacgccgcctgccctggccccggggtccctgctgggtgcggcgcccggcctgccaagtccgcttctacctcagacttccgccagcggcgtcatcttccccaacccgctggtcagcatcgcggccacggccaacgctctggacccgctgtccgcgctcatgaagcaccgcaagggcaagccgcccaatgtgtcggtgttcgagcccaaagccagcgccgaggacccgttcttcaagcacaaatgccgcttctgcgccaaggtcttcggcagcgacagcgcgctccagatccacctgcgctcgcacacaggcgagcggcccttcaagtgcaacatctgcgggaaccgcttctccaccaaaggcaacctgaaggtgcacttccagaggcacaaggagaagtacccccacatccagatgaacccttacccggtccccgagtacctggacaacgtgcccacctgctcgggcatcccctacggcatgtcgctgccccccgagaagcccgtgaccacctggctggacagcaagcccgtgctgcccaccgtgcccacgtccgtggggctgcaactgccgcccgctgtccctggcgcgcacggctacgccgactctcccagcgccaccccagccagccgctccccgcagaggccctcgcccgcctccagcgagtgcgcctccttgtccccaggcctcaaccacgtggagtccggcgtgtcggccaccgccgagtccccacagtcgctcctcggcgggccgcccgtcactaaagccgagcccgtcagcctgccctgcaccaacgccagggccggggacgctcccgtgggcgcgcaggctagcgctgcacccacatcggtggacggcgcacccacgagcctcggcagccccgggctgcccgccgtctccgagcagttcaaggcccagtttccgttcggggggctgctagactcgatgcaaacgtcggaaacctcgaagctgcagcagctggtggagaacatcgacaagaagatgacggacccgaaccagtgcgtcatctgccaccgggtgctgagctgccagagcgcgctgaagatgcactaccggacgcacacgggggagcggccgttcaagtgcaagatctgcggccgcgccttcaccaccaagggcaacctcaagacgcacttcggcgtgcaccgtgcaaagccgcccctgcgcgtgcagcactcctgccccatctgccagaagaagttcaccaacgccgtggtcctgcagcagcacatccgcatgcacatgggcggccagatccccaacacgccgctgccggagggcttccaggatgccatggactccgagctggcctacgacgacaagaacgcggagaccctgagcagctacgatgacgacatggacgagaactccatggaggacgacgctgagctgaaggacgcggccaccgacccggccaagccactcctgtcctatgcggggtcctgcccgccctccccgccctcggtcatctccagcattgccgccctggagaaccagatgaagatgatcgactcggtcatgagctgccagcagctgaccggcctcaagtccgtggagaacgggtccggggagagtgaccgcctgagcaacgactcctcgtcggccgtgggcgacctggagagccgcagcgcgggcagccccgccctgtccgagtcctcgtcctcgcaggccctgtcgccggcccccagcaatggtgagagcttccgctccaagtccccgggcctgggcgccccggaggagccccaggaaatcccgctcaagaccgagaggccggacagcccagccgccgccccgggcagcggaggcgcccctggccgcgcgggcatcaaggaggaggcgcccttcagcctgctgttcctgagcagggagcggggtaagtgtcccagcactgtgtgtggtgtctgtggcaagccttttgcttgcaagagcgcgttggaaatccactaccgcagccatactaaggagcggccattcgtctgcgcgctctgcaggcgagggtgctccactatgggtaatttaaaacagcacttactgacacacagattgaaagagctgccttctcagttatttgaccccaactttgctctaggtcccagccaaagcactcctagcctgatctccagcgccgcacccaccatgatcaaaatggaagtgaacggtcacggcaaggccatggcgctgggcgagggtcccccgctgcccgcgggcgtccaggtccccgccgggcctcagacagtgatgggcccgggcctggcgcccatgctggcccccccaccgcgccggacgcccaagcagcacaactgccagtcgtgcgggaagaccttctcctcggccagcgccctgcagatccatgagcgcacgcacaccggcgagaagccgttcggctgcaccatctgcggccgggccttcaccactaagggcaacctcaaggtgcacatggggacacacatgtggaataacgcccccgcgagacgcggccgccgcctgtctgtggagaaccccatggctctcctagggggtgatgccctgaagttctctgaaatgttccagaaggacctggcagctcgggcaatgaacgtcgaccccagtttttggaaccagtatgctgcagccatcactaacgggctcgccatgaagaacaacgagatctccgtcatccagaacggcggcatcccccagctccccgtgagtcttgggggcagcgccctcccccctctgggcagcatggccagtgggatggacaaagcacgcactggcagtagcccacccatcgtcagcttggacaaagcgagctcagaaacagcagccagccgcccattcacgcggtttatcgaggataacaaggagattggtatcaactag

SEQ ID NO: 185145 - DNA, 838 bp, Homo sapiens; identical to SEQ ID NO: 185143
  Payload ID: 16458
  Gene Symbol: SALL3
  Gene Name: spalt-like transcription factor 3
  ENST ID: ENST00000573324
  CDS Start-End: 1-452

SEQ ID NO: 185146 - DNA, 6555 bp, Homo sapiens; identical to SEQ ID NO: 185140
  Payload ID: 16458
  Gene Symbol: SALL3
  Gene Name: spalt-like transcription factor 3
  Uniprot ID: Q9BXA9
  ENST ID: ENST00000614883
  CDS Start-End: 1-3903

SEQ ID NO: 185147 - DNA, 2958 bp, Homo sapiens
  Payload ID: 16458
  Gene Symbol: SALL3
  Gene Name: spalt-like transcription factor 3
  ENST ID: ENST00000616649
  CDS Start-End: 1-2883
atgtctcggcgcaagcaggccaagccccagcacctcaagtcggacgaggagctgctgccgcctgacggggctcccgagcacgccgccccgggggaaggtgcggaggacgcagacagcgggcccgagagccgcagcgggggcgaggagaccagcgtgtgcgagaaatgctgcgccgagttcttcaagtgggcggacttcctggagcaccagcggagctgcaccaagctcccgcccgtgctgatcgtgcacgaggacgcgccccccggcctgccaagtccgcttctacctcagacttccgccagcggcgtcatcttccccaacccgctggtcagcatcgcggccacggccaacgctctggacccgctgtccgcgctcatgaagcaccgcaagggcaagccgcccaatgtgtcggtgttcgagcccaaagccagcgccgaggacccgttcttcaagcacaaatgccgcttctgcgccaaggtcttcggcagcgacagcgcgctccagatccacctgcgctcgcacacaggcgagcggcccttcaagtgcaacatctgcgggaaccgcttctccaccaaaggcaacctgaaggtgcacttccagaggcacaaggagaagtacccccacatccagatgaacccttacccggtccccgagtacctggacaacgtgcccacctgctcgggcatcccctacggcatgtcgctgccccccgagaagcccgtgaccacctggctggacagcaagcccgtgctgcccaccgtgcccacgtccgtggggctgcaactgccgcccactgtccctggcgcgcacggctacgccgactctcccagcgccaccccagccagccgctccccgcagaggccctcgcccgcctccagcgagtgcgcctccttgtccccaggcctcaaccacgtggagtccggcgtgtcggccaccgccgagtccccacagtcgctcctcggcgggccgcccctcactaaagccgagcccgtcagcctgccctgcaccaacgccagggccggggacgctcccgtgggcgcgcaggctagcgctgcacccacatcggtggacggcgcacccacgagcctcggcagccccgggctgcccgccgtctccgagcagttcaaggcccagtttccgttcggggggctgctagactcgatgcaaacgtcggaaacctcgaagctgcagcagctggtggagaacatcgacaagaagatgacggacccgaaccagtgcgtcatctgccaccgggtgctgagctgccagagcgcgctgaagatgcactaccggacgcacacgggggagcggccgttcaagtgcaagatctgcggccgcgccttcaccaccaagggcaacctcaagacgcacttcggcgtgcaccgtgcaaagccgcccctgcgcgtgcagcactcctgccccatctgccagaagaagttcaccaacgccgtggtcctgcagcagcacatccgcatgcacatgggcggccagatccccaacacgccgctgccggagggcttccaggatgccatggactccgagctggcctacgacgacaagaacgcggagaccctgagcagctacgatgacgacatggacgagaactccatggaggacgacgctgagctgaaggacgcggccaccgacccggccaagccactcctgtcctacgcggggtcctgcccgccctccccgccctcggtcatctccagcattgccgccctggagaaccagatgaagatgatcgactcggtcatgagctgccagcagctgaccggcctcaagtccgtggagaacgggtccggggagagtgaccgcctgagcaacgactcctcgtcggccgtgggcgacctggagagccgcagcgcgggcagccccgccctgtccgagtcctcgtcctcgcaggccctgtcgccggcccccagcaatggtgagagcttccgctccaagtccccgggcctgggcgccccggaggagccccaggaaatcccgctcaagaccgagaggccggacagcccagccgccgccccgggcagcggaggcgcccctggccgcgcgggcatcaaggaggaggcgcccttcagcctgctgttcctgagcagggagcggggtcccagccaaagcactcctagcctgatctccagcgccgcacccaccatgatcaaaatggaagtgaacggtcacggcaaggccatggcgctgggcgagggtcccccgctgcccgcgggcgtccaggtccccgccgggcctcagacagtgatgggcccgggcctggcgcccatgctggcccccccaccgcgccggacgcccaagcagcacaactgccagtcgtgcgggaagaccttctcctcggccagcgccctgcagatccatgagcgcacgcacaccggcgagaagccgttcggctgcaccatctgcggccgggccttcaccactaagggcaacctcaaggtgcacatggggacacacatgtggaataacgcccccgcgagacgcggccgccgcctgtctgtggagaaccccatggctctcctagggggtgatgccctgaagttctctgaaatgttccagaaggacctggcagctcgggcaatgaacgtcgaccccagtttttggaaccagtatgctgcagccatcactaacgggctcgccatgaagaacaacgagatctccgtcatccagaacggcggcatcccccagctccccgtgagtcttgggggcagcgccctcccccctctgggcagcatggccagtgggatggacaaagcacgcactggcagtagcccacccatcgtcagcttggacaaagcgagctcagaaacagcagccagccgcccattcacgcggtttatcgaggataacaaggagattggtatcaactagccagtgactcgctcatctgccctgcccaggcccacgttttgaagttggagcatcaggcctccgacctttcttgcc

SEQ ID NO: 185148 - DNA, 2958 bp, Homo sapiens; identical to SEQ ID NO: 185147
  Payload ID: 16458
  Gene Symbol: SALL3
  Gene Name: spalt-like transcription factor 3
  ENST ID: ENST00000612458
  CDS Start-End: 1-2883

SEQ ID NO: 185149 - DNA, 2955 bp, Homo sapiens
  Payload ID: 16458
  Gene Symbol: SALL3
  Gene Name: spalt-like transcription factor 3
  ENST ID: ENST00000614625
  CDS Start-End: 1-2880
atgtctcggcgcaagcaggccaagccccagcacctcaagtcggacgaggagctgctgccgcctgacggggctcccgagcacgccgccccgggggaaggtgcggaggacgcagacagcgggcccgagagccgcagcgggggcgaggagaccagcgtgtgcgagaaatgctgcgccgagttcttcaagtgggcggacttcctggagcaccagcggagctgcaccaagctcccgcccgtgctgatcgtgcacgaggacgcgcccggcctgccaagtccgcttctacctcagacttccgccagcggcgtcatcttccccaacccgctggtcagcatcgcggccacggccaacgctctggacccgctgtccgcgctcatgaagcaccgcaagggcaagccgcccaatgtgtcggtgttcgagcccaaagccagcgccgaggacccgttcttcaagcacaaatgccgcttctgcgccaaggtcttcggcagcgacagcgcgctccagatccacctgcgctcgcacacaggcgagcggcccttcaagtgcaacatctgcgggaaccgcttctccaccaaaggcaacctgaaggtgcacttccagaggcacaaggagaagtacccccacatccagatgaacccttacccggtccccgagtacctggacaacgtgcccacctgctcgggcatcccctacggcatgtcgctgccccccgagaagcccgtgaccacctggctggacagcaagcccgtgctgcccaccgtgcccacgtccgtggggctgcaactgccgcccgctgtccctggcgcgcacggctacgccgactctcccagcgccaccccagccagccgctccccgcagaggccctcgcccgcctccagcgagtgcgcctccttgtccccaggcctcaaccacgtggagtccggcgtgtcggccaccgccgagtccccacagtcgctcctcggcgggccgcccgtcactaaagccgagcccgtcagcctgccctgcaccaacgccagggccggggacgctcccgtgggcgcgcaggctagcgctgcacccacatcggtggacggcgcacccacgagcctcggcagccccgggctgcccgccgtctccgagcagttcaaggcccagtttccgttcggggggctgctagactcgatgcaaacgtcggaaacctcgaagctgcagcagctggtggagaacatcgacaagaagatgacggacccgaaccagtgcgtcatctgccaccgggtgctgagctgccagagcgcgctgaagatgcactaccggacgcacacgggggagcggccgttcaagtgcaagatctgcggccgcgccttcaccaccaagggcaacctcaagacgcacttcggcgtgcaccgtgcaaagccgcccctgcgcgtgcagcactcctgccccatctgccagaagaagttcaccaacgccgtggtcctgcagcagcacatccgcatgcacatgggcggccagatccccaacacgccgctgccggagggcttccaggatgccatggactccgagctggcctacgacgacaagaacgcggagaccctgagcagctacgatgacgacatggacgagaactccatggaggacgacgctgagctgaaggacgcggccaccgacccggccaagccactcctgtcctatgcggggtcctgcccgccctccccgccctcggtcatctccagcattgccgccctggagaaccagatgaagatgatcgactcggtcatgagctgccagcagctgaccggcctcaagtccgtggagaacgggtccggggagagtgaccgcctgagcaacgactcctcgtcggccgtgggcgacctggagagccgcagcgcgggcagccccgccctgtccgagtcctcgtcctcgcaggccctgtcgccggcccccagcaatggtgagagcttccgctccaagtccccgggcctgggcgccccggaggagccccaggaaatcccgctcaagaccgagaggccggacagcccagccgccgccccgggcagcggaggcgcccctggccgcgcgggcatcaaggaggaggcgcccttcagcctgctgttcctgagcagggagcggggtcccagccaaagcactcctagcctgatctccagcgccgcacccaccatgatcaaaatggaagtgaacggtcacggcaaggccatggcgctgggcgagggtcccccgctgcccgcgggcgtccaggtccccgccgggcctcagacagtgatgggcccgggcctggcgcccatgctggcccccccaccgcgccggacgcccaagcagcacaactgccagtcgtgcgggaagaccttctcctcggccagcgccctgcagatccatgagcgcacgcacaccggcgagaagccgttcggctgcaccatctgcggccgggccttcaccactaagggcaacctcaaggtgcacatggggacacacatgtggaataacgcccccgcgagacgcggccgccgcctgtctgtggagaaccccatggctctcctagggggtgatgccctgaagttctctgaaatgttccagaaggacctggcagctcgggcaatgaacgtcgaccccagtttttggaaccagtatgctgcagccatcactaacgggctcgccatgaagaacaacgagatctccgtcatccagaacggcggcatcccccagctccccgtgagtcttgggggcagcgccctcccccctctgggcagcatggccagtgggatggacaaagcacgcactggcagtagcccacccatcgtcagcttggacaaagcgagctcagaaacagcagccagccgcccattcacgcggtttatcgaggataacaaggagattggtatcaactagccagtgactcgctcatctgccctgcccaggcccacgttttgaagttggagcatcaggcctccgacctttcttgcc

SEQ ID NO: 185150 - DNA, 838 bp, Homo sapiens; identical to SEQ ID NO: 185143
  Payload ID: 16458
  Gene Symbol: SALL3
  Gene Name: spalt-like transcription factor 3
  ENST ID: ENST00000633138
  CDS Start-End: 1-452

SEQ ID NO: 185151 - DNA, 3996 bp, Homo sapiens; identical to SEQ ID NO: 185141
  Payload ID: 16458
  Gene Symbol: SALL3
  Gene Name: spalt-like transcription factor 3
  Uniprot ID: Q9BXA9
  ENST ID: ENST00000631929
  CDS Start-End: 1-3687

SEQ ID NO: 185152 - DNA, 3997 bp, Homo sapiens; identical to SEQ ID NO: 185139
  Payload ID: 16458
  Gene Symbol: SALL3
  Gene Name: spalt-like transcription factor 3
  Uniprot ID: Q9BXA9
  ENST ID: ENST00000633643
  CDS Start-End: 710-3997

SEQ ID NO: 185153 - DNA, 5208 bp, Homo sapiens
  Payload ID: 16459
  Gene Symbol: SALL4
  Gene Name: spalt-like transcription factor 4
  Uniprot ID: Q9UJQ4
  ENST ID: ENST00000217086
  CDS Start-End: 113-3274
attactgggacatgcgcgttccggccgaaggggggtaaatttcccaactccaggaatttgtggcggagagggcaaataactgcggctctcccggcgccccgatgctcgcaccatgtcgaggcgcaagcaggcgaaaccccagcacatcaactcggaggaggaccagggcgagcagcagccgcagcagcagaccccggagtttgcagatgcggccccagcggcgcccgcggcgggggagctgggtgctccagtgaaccacccagggaatgacgaggtggcgagtgaggatgaagccacagtaaagcggcttcgtcgggaggagacgcacgtctgtgagaaatgctgtgcggagttcttcagcatctctgagttcctggaacataagaaaaattgcactaaaaatccacctgtcctcatcatgaatgacagcgaggggcctgtgccttcagaagacttctccggagctgtactgagccaccagcccaccagtcccggcagtaaggactgtcacagggagaatggcggcagctcagaggacatgaaggagaagccggatgcggagtctgtggtgtacctaaagacagagacagccctgccacccaccccccaggacataagctatttagccaaaggcaaagtggccaacactaatgtgaccttgcaggcactacggggcaccaaggtggcggtgaatcagcggagcgcggatgcactccctgcccccgtgcctggtgccaacagcatcccgtgggtcctcgagcagatcttgtgtctgcagcagcagcagctacagcagatccagctcaccgagcagatccgcatccaggtgaacatgtgggcctcccacgccctccactcaagcggggcaggggccgacactctgaagaccttgggcagccacatgtctcagcaggtttctgcagctgtggctttgctcagccagaaagctggaagccaaggtctgtctctggatgccttgaaacaagccaagctacctcacgccaacatcccttctgccaccagctccctgtccccagggctggcacccttcactctgaagccggatgggacccgggtgctcccgaacgtcatgtcccgcctcccgagcgctttgcttcctcaggccccgggctcggtgctcttccagagccctttctccactgtggcgctagacacatccaagaaagggaaggggaagccaccgaacatctccgcggtggatgtcaaacccaaagacgaggcggccctctacaagcacaagtgtaagtactgtagcaaggtttttgggactgatagctccttgcagatccacctccgctcccacactggagagagacccttcgtgtgctctgtctgtggtcatcgcttcaccaccaagggcaacctcaaggtgcactttcaccgacatccccaggtgaaggcaaacccccagctgtttgccgagttccaggacaaagtggcggccggcaatggcatcccctatgcactctctgtacctgaccccatagatgaaccgagtctttctttagacagcaaacctgtccttgtaaccacctctgtagggctacctcagaatctttcttcggggactaatcccaaggacctcacgggtggctccttgcccggtgacctgcagcctgggccttctccagaaagtgagggtggacccacactccctggggtgggaccaaactataattccccaagggctggtggcttccaagggagtgggacccctgagccagggtcagagaccctgaaattgcagcagttggtggagaacattgacaaggccaccactgatcccaacgaatgtctcatttgccaccgagtcttaagctgtcagagctccctcaagatgcattatcgcacccacaccggggagagaccgttccagtgtaagatctgtggccgagccttttctaccaaaggtaacctgaagacacaccttggggttcaccgaaccaacacatccattaagacgcagcattcgtgccccatctgccagaagaagttcactaatgccgtgatgctgcagcaacatattcggatgcacatgggcggtcagattcccaacacgcccctgccagagaatccctgtgactttacgggttctgagccaatgaccgtgggtgagaacggcagcaccggcgctatctgccatgatgatgtcatcgaaagcatcgatgtagaggaagtcagctcccaggaggctcccagcagctcctccaaggtccccacgcctcttcccagcatccactcggcatcacccacgctagggtttgccatgatggcttccttagatgccccagggaaagtgggtcctgccccttttaacctgcagcgccagggcagcagagaaaacggttccgtggagagcgatggcttgaccaacgactcatcctcgctgatgggagaccaggagtatcagagccgaagcccagatatcctggaaaccacatccttccaggcactctccccggccaatagtcaagccgaaagcatcaagtcaaagtctcccgatgctgggagcaaagcagagagctccgagaacagccgcactgagatggaaggtcggagcagtctcccttccacgtttatccgagccccgccgacctatgtcaaggttgaagttcctggcacatttgtgggaccctcgacattgtccccagggatgacccctttgttagcagcccagccacgccgacaggccaagcaacatggctgcacacggtgtgggaagaacttctcgtctgctagcgctcttcagatccacgagcggactcacactggagagaagccttttgtgtgcaacatttgtgggcgagcttttaccaccaaaggcaacttaaaggttcactacatgacacacggggcgaacaataactcagcccgccgtggaaggaagttggccatcgagaacaccatggctctgttaggtacggacggaaaaagagtctcagaaatctttcccaaggaaatcctggccccttcagtgaatgtggaccctgttgtgtggaaccagtacaccagcatgctcaatggcggtctggccgtgaagaccaatgagatctctgtgatccagagtgggggggttcctaccctcccggtttccttgggggccacctccgttgtgaataacgccactgtctccaagatggatggctcccagtcgggtatcagtgcagatgtggaaaaaccaagtgctactgacggcgttcccaaacaccagtttcctcacttcctggaagaaaacaagattgcggtcagctaagggagaacttgcgtggaaggagcaatgcagacacagtgaaatctctagaatctgctttgttttgtaagaactcatctcctcctgttttctttttcttactgatatgcaaatgatgtttactacgttggttgtgaccacaacctcaggcaagtgctacaatcacgattgttgctatgctgctttgcaaaaagttgaaaaaataaaaaaaaaatgcataccaaaacaaatacagactctttttttttgagatggagtctcgctctatcacccaggctggagtgcagtggcatgatctcggctcactgcaacctccccattctgggttcaagtgattctcctgccttagcctccagagtagctgggattacaggcaggtgccaccacgcccggctaattttgtattttgagtagagactgggtttcaccatgttggtcaggctggtctcgaactgctgacctcgtgatccacccgccttggcctcccaaagtgctgggattacaggcatgagctaccacgcctggcactttttttttttttttctaattttggaaagaagcgggtcttgcaaagtagctttgttacttgtaacagacgtatacatagaacctttgtacaacctagagtgactttttccaaagactgttacctatttcaaggtagaatcgttggaacttactgaacaacagtggaaaagacaactacacagcctcattgaggggagatgggtactgtatacttactggtaactggacacgggtaaaaggacaaggtctgtcatctctttagggacctgttttatatgccccaaccctgtccccatcttattgtttttttttgaatgtacttaaaaaaggaacaacaaaaaactagggttgtagaattataaaactgcttcaaccttagaaccttaagtaggaggccctcaaatggacttacgttagtccttagggagtcaatgtgtgtgttgctgcttatttaaatacagttcagttggagccccgagagtgccaatgttttccccacacctcttggatgccttcctcttcccaaatcccagaagaggtgggcacctgagcggggaatctcaggtgacttagtttgccagtgcctactctattgaagaactgggttttcatgctcgagaagaaactcgtggaagggcgtgtttcccatcacaggttcacatactgattgcttttgttgaatttccttggtgcgacttatgccaagtaattatgacgattttttgttttgttttgtttccttgctgaatatttcatgaaggctacgaagttagaacaggcacgtcctgggtgtgaaagctttaatttatctacctcatttattttttattttttgtagccatagtgtctattttcctattttaagaccgctgaagtattcccaggccctgtctaaagcctaagagttgatgtattggtgggaagaggtgaacgttcaagatgattttgtgatgccttttttttttgtagtttcctttgtaaatgtgatattgagcaaacgaaacattgctcttggtttaacaagaaagaaagaaaaaaactctaatttctgggagaaaagtctttcccctctatgtggaaggtcctgacggaaatatgcatccaagacgattagccaaagtgttgtctcttcatcgttgcacctgactttaggattccgccccccttttttttttttttttttttttttgccaagttgtgcctttccttctggaattgtaagtgaacacgataatagtacctgtttacactgtgaagtggatattgttacagaaaacacaccagtggctttctcactgttgagctaataatgccttgtgaatgtatgatctacggagaaacccctgtagttgtacctgctgatgctgtctgtctgttggaaaataaaatttgaatgtttttttttctca

SEQ ID NO: 185154 - DNA, 1151 bp, Homo sapiens
  Payload ID: 16459
  Gene Symbol: SALL4
  Gene Name: spalt-like transcription factor 4
  ENST ID: ENST00000371539
  CDS Start-End: 102-932
atgcgcgttccggccgaaggggggtaaatttcccaactccaggaatttgtggcggagagggcaaataactgcggctctcccggcgccccgatgctcgcaccatgtcgaggcgcaagcaggcgaaaccccagcacatcaactcggaggaggaccagggcgagcagcagccgcagcagcagaccccggagtttgcagatgcggccccagcggcgcccgcggcgggggagctgggtcggagcagtctcccttccacgtttatccgagccccgccgacctatgtcaaggttgaagttcctggcacatttgtgggaccctcgacattgtccccagggatgacccctttgttagcagcccagccacgccgacaggccaagcaacatggctgcacacggtgtgggaagaacttctcgtctgctagcgctcttcagatccacgagcggactcacactggagagaagccttttgtgtgcaacatttgtgggcgagcttttaccaccaaaggcaacttaaaggttcactacatgacacacggggcgaacaataactcagcccgccgtggaaggaagttggccatcgagaacaccatggctctgttaggtacggacggaaaaagagtctcagaaatctttcccaaggaaatcctggccccttcagtgaatgtggaccctgttgtgtggaaccagtacaccagcatgctcaatggcggtctggccgtgaagaccaatgagatctctgtgatccagagtgggggggttcctaccctcccggtttccttgggggccacctccgttgtgaataacgccactgtctccaagatggatggctcccagtcgggtatcagtgcagatgtggaaaaaccaagtgctactgacggcgttcccaaacaccagtttcctcacttcctggaagaaaacaagattgcggtcagctaagggagaacttgcgtggaaggagcaatgcagacacagtgaaatctctagaatctgctttgttttgtaagaactcatctcctcctgttttctttttcttactgatatgcaaatgatgtttactacgttggttgtgaccacaacctcaggcaagtgctacaatcacgattgttgctatgctgctttgcaaaaagttgaaaaaataaaaaaaaaatgcatacc

SEQ ID NO: 185155 - DNA, 1918 bp, Homo sapiens
  Payload ID: 16459
  Gene Symbol: SALL4
  Gene Name: spalt-like transcription factor 4
  Uniprot ID: Q9UJQ4
  ENST ID: ENST00000395997
  CDS Start-End: 68-1918
aactccaggaatttgtggcggagagggcaaataactgcggctctcccggcgccccgatgctcgcaccatgtcgaggcgcaagcaggcgaaaccccagcacatcaactcggaggaggaccagggcgagcagcagccgcagcagcagaccccggagtttgcagatgcggccccagcggcgcccgcggcgggggagctgggtgctccagtgaaccacccagggaatgacgaggtggcgagtgaggatgaagccacagtaaagcggcttcgtcgggaggagacgcacgtctgtgagaaatgctgtgcggagttcttcagcatctctgagttcctggaacataagaaaaattgcactaaaaatccacctgtcctcatcatgaatgacagcgaggggcctgtgccttcagaagacttctccggagctgtactgagccaccagcccaccagtcccggcagtaaggactgtcacagggagaatggcggcagctcagaggacatgaaggagaagccggatgcggagtctgtggtgtacctaaagacagagacagccctgccacccaccccccaggacataagctatttagccaaaggcaaagtggccaacactaatgtgaccttgcaggcactacggggcaccaaggtggcggtgaatcagcggagcgcggatgcactccctgcccccgtgcctggtgccaacagcatcccgtgggtcctcgagcagatcttgtgtctgcagcagcagcagctacagcagatccagctcaccgagcagatccgcatccaggtgaacatgtgggcctcccacgccctccactcaagcggggcaggggccgacactctgaagaccttgggcagccacatgtctcagcaggtttctgcagctgtggctttgctcagccagaaagctggaagccaaggtctgtctctggatgccttgaaacaagccaagctacctcacgccaacatcccttctgccaccagctccctgtccccagggctggcacccttcactctgaagccggatgggacccgggtgctcccgaacgtcatgtcccgcctcccgagcgctttgcttcctcaggccccgggctcggtgctcttccagagccctttctccactgtggcgctagacacatccaagaaagggaaggggaagccaccgaacatctccgcggtggatgtcaaacccaaagacgaggcggccctctacaagcacaagtgtcggagcagtctcccttccacgtttatccgagccccgccgacctatgtcaaggttgaagttcctggcacatttgtgggaccctcgacattgtccccagggatgacccctttgttagcagcccagccacgccgacaggccaagcaacatggctgcacacggtgtgggaagaacttctcgtctgctagcgctcttcagatccacgagcggactcacactggagagaagccttttgtgtgcaacatttgtgggcgagcttttaccaccaaaggcaacttaaaggttcactacatgacacacggggcgaacaataactcagcccgccgtggaaggaagttggccatcgagaacaccatggctctgttaggtacggacggaaaaagagtctcagaaatctttcccaaggaaatcctggccccttcagtgaatgtggaccctgttgtgtggaaccagtacaccagcatgctcaatggcggtctggccgtgaagaccaatgagatctctgtgatccagagtgggggggttcctaccctcccggtttccttgggggccacctccgttgtgaataacgccactgtctccaagatggatggctcccagtcgggtatcagtgcagatgtggaaaaaccaagtgctactgacggcgttcccaaacaccagtttcctcacttcctggaagaaaacaagattgcggtcagctaa

SEQ ID NO: 185156 - DNA, 691 bp, Homo sapiens
  Payload ID: 16460
  Gene Symbol: SPANXA2
  Gene Name: SPANX family, member A2
  Uniprot ID: Q9NS26
  ENST ID: ENST00000370518
  CDS Start-End: 334-627
attaaacatggagaaatgaggagcggcggcagatcggtttgggatgcatcttcaggggatgctgaaacaacagcagcatttggtttgctctacacccctgtcacccctcgcccgcaagcccagggagtggtcagcagtggggctttgtgatgtgaagccaccctagggctgccattggctgggacactgcctgtatgatcaaacaaagctcaagggtgtggctttgccttgtcaccaggagggtatacatagggagggcaagagctccgggccactgagaagattcaaaacctacaaaagcctgccactgacattgaagaaccaatatatacaatggacaaacaatccagtgccggcggggtgaagaggagcgtcccctgtgattccaacgaggccaacgagatgatgccggagaccccaactggggactcagacccgcaacctgctcctaaaaaaatgaaaacatctgagtcctcgaccatactagtggttcgctacaggaggaactttaaaagaacatctccagaggaactgctgaatgaccacgcccgagagaacagaatcaaccccctccaaatggaggaggaggaattcatggaaataatggttgaaatacctgcaaagtagcaagaagctacatctctcaaccttgggcaatgaaaataaagtttgagaagctgatggctgtgta

SEQ ID NO: 185157 - DNA, 469 bp, Homo sapiens
  Payload ID: 16461
  Gene Symbol: SPANXB1
  Gene Name: SPANX family, member B1
  Uniprot ID: Q9NS25
  ENST ID: ENST00000449283
  CDS Start-End: 104-415
gtcaccaggagggtatgcatagggagggcaagagctctgggccactgcgaagattcaaaagctccaaaaacctactgtagacatcgaagaaccaatatatacaatgggccaacaatccagtgtccgcaggctgaagaggagcgtcccctgtgaatccaacgaggccaacgaggccaatgaggccaacaagacgatgccggagaccccaactggggactcagacccgcaacctgctcctaaaaaaatgaaaacatctgagtcctcgaccatactagtggttcgctacaggaggaacgtgaaaagaacatctccagaggaactgctgaatgaccacgcccgagagaacagaatcaaccccgaccaaatggaggaggaggaattcatagaaataacgactgaaagacctaaaaagtagcaagaagctacatccctcaaacttcggcaatgaaaataaagtttgagaagctga

SEQ ID NO: 185158 - DNA, 387 bp, Homo sapiens
  Payload ID: 16462
  Gene Symbol: SPANXC
  Gene Name: SPANX family, member C
  Uniprot ID: Q9NY87
  ENST ID: ENST00000358993
  CDS Start-End: 40-333
caaaagcctgccgctgacattgaagaaccaatatatacaatggacaaacaatccagtgccggcggggtgaagaggagcgtcccctgtgattccaacgaggccaacgagatgatgccggagacctcgagtgggtactcagacccgcaacctgctccgaaaaaactaaaaacatctgagtcctcgaccatactagtggttcgctacaggaggaacgtgaaaagaacatctccagaggaactggtgaatgaccacgcccgagagaacagaatcaaccccctccaaatggaggaggaggaattcatggaaataatggttgaaatacctgcaaagtagcaagaagctacatctctcaaccttgggcaatgaaaataaagtttgagaagctga

SEQ ID NO: 185159 - DNA, 682 bp, Homo sapiens
  Payload ID: 16463
  Gene Symbol: SPANXD
  Gene Name: SPANX family, member D
  Uniprot ID: Q9BXN6
  ENST ID: ENST00000370515
  CDS Start-End: 335-628
attaaacatggagaaatgaggagcggcggcagatcggtttgggatgcatcttcaggggatgctgaaacaacagcagcatttggtttgctctacacccctgtcacccctcgcccgcaagcccagggagtggtcagcagtggggctttgtgacgtcgaagccaccctagggctgccattggctgggacactgcctgtatgatcaaacaaagctcaagggtgtggctttgccttgtcaccaggagggtatacatagggagggcaagagctccgggccactgagaagattcaaaacctacaaaagcctgccgctgacattgaagaaccaatatatacaatggacaaacaatccagtgccggcggggtgaagaggagcgtcccctgtgattccaacgaggccaacgagatgatgccggagacctcgagtgggtactcagacccgcaacctgctccgaaaaaactaaaaacatctgagtcctcgaccatactagtggttcgctacaggaggaactttaaaagaacatctccagaggaactggtgaatgaccacgcccgaaagaacagaatcaaccccctccaaatggaggaggaggaattcatggaaataatggttgaaatacctgcaaagtagcaagaagctacatctctcaaccttgggcaatgacaataaagtttgagaagctga

SEQ ID NO: 185160 - DNA, 1276 bp, Homo sapiens
  Payload ID: 16464
  Gene Symbol: SPANXN1
  Gene Name: SPANX family, member N1
  Uniprot ID: Q5VSR9
  ENST ID: ENST00000370493
  CDS Start-End: 760-978
acacccctgatttgaaacaagactaggatacatggtaaagaatgtttattcactaaagttttgacagactgaaggccattatttcagattggagataggaaacttaaaagaactacatggacattgggtaaaagaacatgggttgaaatttgcctggcagtagcccaaaagtaaatggtcttcgaggtgcatgtgaaggaactgtaggagggaaatgggataattcacatctccaccaataattacatgtagccacactagcttgggggatttgaggtgagacatctaaaatactaagtcatggtgagggctggaagacaaaagaatgaatcacttcataggaatggctgtggggaagggcttgaaggaatcatcctctgacttccatgtgaaccatgaacattaaacatggagaaatgaggagcggcggcagatcggtttgggatgcatcttcaggggatgctgaaacaacaacagcatttggtttcctctacatccctgtcacccctcccccacaagcccagggattggtcagcagtggtgcttcgtgatgtcaaagccaccctaggactgccattggctgggacactgcctgtatgatcaaacaaagctcaagggtgtggctttgccttgtcaccaggagggtatatatagggagggcaagagctctgggacatcctcctgggaagcttcaatacagctgtgcaagtctggagtctacaagagcctactatagacattctacaaccaaccagaatcatggaacagcccacttcaagcatcaatggggagaagaggaagagcccctgtgaatccaacaatgaaaatgatgagatgcaggagacaccaaacagggacttagcccccgaaccgagtttgaaaaagatgaaaacgtcagaatattcaacagtattagcgttttgctacaggaaagctaagaaaatacattcaaatcaactggagaatgaccagtcctgagagaactccatcaatccagtccaagaggaggaggacgaaggcctagactcagctgaaggatcttcaaagcaggatgaagacctagacttacctgaaggcctagactcagctgaaggatcttcaaagcaggatgaagacctagacttacctgaaggatcttcaaagcagaatgaagacctaggcttacctgaaggatcttcaaagcaggatgaagacctagacttacctgaaggatcttcacaggaggataaagacgtagaattacctgaaggatcttcacaggaggatgaagacctag

SEQ ID NO: 185161 - DNA, 1378 bp, Homo sapiens
  Payload ID: 16465
  Gene Symbol: SPANXN2
  Gene Name: SPANX family, member N2
  Uniprot ID: Q5MJ10
  ENST ID: ENST00000598475
  CDS Start-End: 756-1298
acccctgatttgaaacaagactaggatacatggtaaagaaagtttattcaccaaagttttgacagactgaaggccattatttcagattggagataggaaacttaaaagaactacatggacattgggtaaaagaacatgggttgaaatttgcctggcagtagcctaaaagtaaatggtcttcaaggtgcatgtgaaggaactgtaggagggaaatgggataattcacatctccaccaataattaaatgtagccacactagcttggagggatttgaggtgagacatctaaaatactaagtcatggtgagggctggaagacaaaagaatgaatgacttcataggaatgactgtggggaagggcttgaaggaatcatcctctcacttccatgtgaaccatgaacattaaacatggagaaatgagcagcagcagattagtttgggatgcatcttcaggggatgctgaaacaacaacagcatttggtttcctctacacccctgtcatccgtcccccacaagcccagggagtggtcagcagtggtgctttgtgatgtctaagccaccctaggactgccattggctgggacactgcctgtatgatcaaacaaagctcaagagtgtggctttgccttgccaccaggaaggtatacatagggagggccagagctctgggacatcctcctggcaagcttcaatatagctgtggaagtctgcagtctacaagagcctactatagacattctacaaccaagcagaatcatggaacagccgacttcaagcaccaatggggagaagaggaagagcccctgtgaatccaataacaaaaaaaatgatgagatgcaggaggcaccgaacagggtcttagcccccaaacagagcttgcaaaagacaaaaacaatagaatatctaacaataatagtgtattactacaggaagcatacgaaaataaattcaaatcaactggagaaggaccagtcccgagagaactccatcaatccagtccaagaggaggaggacgaaggcctagactcagctgaaggatcttcacaggaggacgaagacctggactcatctgaaggatcttcacaggaggacgaagacctggactcatctgaaggatcttcacaggaggacgaagacctggactcatctgaaggatcttcacaggaggacgaagacctggactcatctgaaggatcttcacaggaggacgaagacctggacccacctgaaggatcttcacaggaggacgaagacctagactcatctgaaggatcttcacaggagggtggggaggactagtcaaacatggagaaaccaaattggacaaatcctcactaccaatggcgatgattacaataaaatcaagtttgaggagctga

SEQ ID NO: 185162 - DNA, 590 bp, Homo sapiens
  Payload ID: 16466
  Gene Symbol: SPANXN3
  Gene Name: SPANX family, member N3
  Uniprot ID: Q5MJ09
  ENST ID: ENST00000370503
  CDS Start-End: 85-510
atcccactgggaagcttcaacatagctgtggaagtctgcagtctacaggagcctactatagacattctacaaccaaccagaatcatggaacagccaacttccagcaccaatggggagaagacgaagagcccctgtgaatccaataacaaaaaaaatgatgagatgcaagaggtaccaaacagagtcttagcccccgaacagagtttgaagaacacaaaaacatcagaatatccaataatatttgtgtattacctcaggaagggtaagaaaataaattcaaatcaactggagaatgaacagtcccaagagaactccatcaatccaatccaaaaggaggaggacgaaggcgtagacttatctgaaggatcttcaaatgaggatgaagacctaggcccatgtgaaggaccttcaaaggaggacaaagatctagactcatctgaaggatcctcacaggaggatgaagacctaggcttatctgaaggatcttcacaggacagtggggaggattagtcacacatggagaaaccaaattggacaaatcatcaccactgatggcgatgattacaataaaatcaagtttaaggagctga

SEQ ID NO: 185163 - DNA, 560 bp, Homo sapiens
  Payload ID: 16467
  Gene Symbol: SPANXN4
  Gene Name: SPANX family, member N4
  ENST ID: ENST00000370504
  CDS Start-End: 84-554
gcccactggaaagcttcaatacagctgtggaaatctgcaccctagaagatcctagtacagaaattctacaaccaaccataatcatggaagagccaacttccagcaccaacgagaataaaatgaagagcccctgtgaatctaacaaaagaaaagttgacaagaagaagaatctgcacagagcctcagcccctgaacagagtttgaaagagacagaaaaagcaaaatatccaacattagtgttttactgcaggaagaataagaaaagaaattcaaatcaactggagaataaccagcctacagagagctccactgatccaatcaaagagaaaggagacctagacatatctgcaggatctccacaggatggagaggaagaaaaggatttggtgttccttggagcacgtgcatgtttagaagagcacataagaagatctgtattgtatgtaggtgacagtgacactctttccaaaatgaagacatcagaatcaccaccttcaggccacatacctcagagtggtgtgttttgtaactcacccaatgctgtgagcaactgaaggtcc

SEQ ID NO: 185164 - DNA, 431 bp, Homo sapiens
  Payload ID: 16467
  Gene Symbol: SPANXN4
  Gene Name: SPANX family, member N4
  Uniprot ID: Q5MJ08
  ENST ID: ENST00000446864
  CDS Start-End: 98-397
aaagctctgggacagcccactggaaagcttcaatacagctgtggaaatctgcaccctagaagatcctagtacagaaattctacaaccaaccataatcatggaagagccaacttccagcaccaacgagaataaaatgaagagcccctgtgaatctaacaaaagaaaagttgacaagaagaagaagaatctgcacagagcctcagcccctgaacagagtttgaaagagacagaaaaagcaaaatatccaacattagtgttttactgcaggaagaataagaaaagaaattcaaatcaactggagaataaccagcctacagagagctccactgatccaatcaaagagaaaggagacctagacatatctgcaggatctccacaggatggtgggcagaattagtccaaattggacaaatcatcaccactgatggcga

SEQ ID NO: 185165 - DNA, 1316 bp, Homo sapiens
  Payload ID: 16468
  Gene Symbol: SPANXN5
  Gene Name: SPANX family, member N5
  Uniprot ID: Q5MJ07
  ENST ID: ENST00000375511
  CDS Start-End: 754-972
acacccctgatttgaaacaagactaggatgcaaggtaaagaatgttaattcactaaagttttgacagactgaggccattgtttcagattggaaataggaaacttaaaagaactacatggacattgggtaaaagaacatgggttgaaatttgcctggcagtagcccaagagtaaatggtcttcaaggtgcatatgaaggaactgtaagagggaaatgggataattcacatctccaccaataattaaatgtagccacactagcttgggggatttgaggtgagacatctaaaatactaagtcatggtgagggctggaagacaaaagaatgaatcacttaataggaatggctgtggggaagggcttgacagaatcaacctctcacttccatgtgaaccatgaacattaaacatggagaaatgaggagcggcagcagatcagtttgggatgcgtcttcaggggatgctgaaacaacagcagcatttggtttcctctacacccctgtcacccctcccccacaagcccagggagtggtcagcagtggtgctttgtgatgtctaagccacccttggactgccattggctgggacactgcctgtatgatcaaacaaagctcaagggtgtggctttgccttgtcaccaggagggtatatatagggagggcaagagctctgggccactgggaagcttcaatatagctgtggaagtctggactctacaagatcctgctgtagacattcaacaaccaaccagaatcatggaaaagcccacttcaagcaccaatggggagaagaggaagagcccctgtgactccaacagcaaaaatgatgagatgcaggagacaccaaacagggacttagtcctcgaaccgagtttgaaaaagatgaaaacatcagaatattcaacagtattagtgttgtgctacaggaagactaagaaaatacattcaaatcaactcgagaatgaccagtcctgagagaactccatcaatccagtccaagaggaggaggacgaaggatcctcacaggaggacgaagacctagactcatctgcagaatcttcaaagcaggatgaagacctacaattacctgaaggatcttcacaggaggatgaagacctagggttatctgaaggatcttcacaagaggatgaagacctagactcatctgaaggatctttgatggaggaagaagacccagactcatctgaaggatcgtcagaggagggtgaggaagactaattaaacatggagaaaccaaattggacaaatcctcaccaccaacggtgatgattacaataaaatcaagtttgagaagctga

SEQ ID NO: 185166 - DNA, 2040 bp, Homo sapiens
  Payload ID: 16469
  Gene Symbol: SMOC1
  Gene Name: SPARC related modular calcium binding 1
  Uniprot ID: Q9H4F8
  ENST ID: ENST00000361956
  CDS Start-End: 264-1571
aggcgtccaacctgctgccgcctgggccccgccgagcggagctagcgccgcgcgcagagcacacgctcgcgctccagctcccctcctgcgcggttcatgactgtgtcccctgaccgcagcctctgcgagcccccgccgcaggaccacggcccgctccccgccgccgcgagggccccgagcgaaggaaggaagggaggcgcgctgtgcgccccgcggagcccgcgaaccccgctcgctgccggctgcccagcctggctggcaccatgctgcccgcgcgctgcgcccgcctgctcacgccccacttgctgctggtgttggtgcagctgtcccctgctcgcggccaccgcaccacaggccccaggtttctaataagtgaccgtgacccacagtgcaacctccactgctccaggactcaacccaaacccatctgtgcctctgatggcaggtcctacgagtccatgtgtgagtaccagcgagccaagtgccgagacccgaccctgggcgtggtgcatcgaggtagatgcaaagatgctggccagagcaagtgtcgcctggagcgggctcaagccctggagcaagccaagaagcctcaggaagctgtgtttgtcccagagtgtggcgaggatggctcctttacccaggtgcagtgccatacttacactgggtactgctggtgtgtcaccccggatgggaagcccatcagtggctcttctgtgcagaataaaactcctgtatgttcaggttcagtcaccgacaagcccttgagccagggtaactcaggaaggaaagatgacgggtctaagccgacacccacgatggagacccagccggtgttcgatggagatgaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaagtaggacgcctcgtctaaggagcagaaaacccaagggcaggtggagagtccagggaggcaggatggatcaccagacacctaaccttcagcgttgcccatggccctgccacatcccgtgtaacataagtggtgcccaccatgtttgcacttttaataactcttacttgcgtgttttgtttttggtttcattttaaaacaccaatatctaataccacagtgggaaaaggaaagggaagaaagactttattctctctcttattgtaagtttttggatctgctactgacaacttttagagggttttgggggggtgggggagggtgttgttggggctgagaagaaagagatttatatgctgtatataaatatatatgtaaattgtatagttcttttgtacaggcattggcattgctgtttgtttatttctctccctctgcctgctgtgggtggtgggcactctggacacatagtccagctttctaaaatcca

SEQ ID NO: 185167 - DNA, 3666 bp, Homo sapiens
  Payload ID: 16469
  Gene Symbol: SMOC1
  Gene Name: SPARC related modular calcium binding 1
  Uniprot ID: Q9H4F8
  ENST ID: ENST00000381280
  CDS Start-End: 254-1558
cctgctgccgcctgggccccgccgagcggagctagcgccgcgcgcagagcacacgctcgcgctccagctcccctcctgcgcggttcatgactgtgtcccctgaccgcagcctctgcgagcccccgccgcaggaccacggcccgctccccgccgccgcgagggccccgagcgaaggaaggaagggaggcgcgctgtgcgccccgcggagcccgcgaaccccgctcgctgccggctgcccagcctggctggcaccatgctgcccgcgcgctgcgcccgcctgctcacgccccacttgctgctggtgttggtgcagctgtcccctgctcgcggccaccgcaccacaggccccaggtttctaataagtgaccgtgacccacagtgcaacctccactgctccaggactcaacccaaacccatctgtgcctctgatggcaggtcctacgagtccatgtgtgagtaccagcgagccaagtgccgagacccgaccctgggcgtggtgcatcgaggtagatgcaaagatgctggccagagcaagtgtcgcctggagcgggctcaagccctggagcaagccaagaagcctcaggaagctgtgtttgtcccagagtgtggcgaggatggctcctttacccaggtgcagtgccatacttacactgggtactgctggtgtgtcaccccggatgggaagcccatcagtggctcttctgtgcagaataaaactcctgtatgttcaggttcagtcaccgacaagcccttgagccagggtaactcaggaaggaaagatgacgggtctaagccgacacccacgatggagacccagccggtgttcgatggagatgaaatcacagccccaactctatggattaaacacttggtgatcaaggactccaaactgaacaacaccaacataagaaattcagagaaagtctattcgtgtgaccaggagaggcagagtgccctggaagaggcccagcagaatccccgtgagggtattgtcatccctgaatgtgcccctgggggactctataagccagtgcaatgccaccagtccactggctactgctggtgtgtgctggtggacacagggcgcccgctgcctgggacctccacacgctacgtgatgcccagttgtgagagcgacgccagggccaagactacagaggcggatgaccccttcaaggacagggagctaccaggctgtccagaagggaagaaaatggagtttatcaccagcctactggatgctctcaccactgacatggttcaggccattaactcagcagcgcccactggaggtgggaggttctcagagccagaccccagccacaccctggaggagcgggtagtgcactggtatttcagccagctggacagcaatagcagcaacgacattaacaagcgggagatgaagcccttcaagcgctacgtgaagaagaaagccaagcccaagaaatgtgcccggcgtttcaccgactactgtgacctgaacaaagacaaggtcatttcactgcctgagctgaagggctgcctgggtgttagcaaagaaggacgcctcgtctaaggagcagaaaacccaagggcaggtggagagtccagggaggcaggatggatcaccagacacctaaccttcagcgttgcccatggccctgccacatcccgtgtaacataagtggtgcccaccatgtttgcacttttaataactcttacttgcgtgttttgtttttggtttcattttaaaacaccaatatctaataccacagtgggaaaaggaaagggaagaaagactttattctctctcttattgtaagtttttggatctgctactgacaacttttagagggttttgggggggtgggggagggtgttgttggggctgagaagaaagagatttatatgctgtatataaatatatatgtaaattgtatagttcttttgtacaggcattggcattgctgtttgtttatttctctccctctgcctgctgtgggtggtgggcactctggacacatagtccagctttctaaaatccaggactctatcctgggcctactaaacttctgtttggagactgacccttgtgtataaagacgggagtcctgcaattgtactgcggactccacgagttcttttctggtgggaggactatattgccccatgccattagttgtcaaaattgataagtcacttggctctcggccttgtccagggaggttgggctaaggagagatggaaactgccctgggagaggaagggagtccagatcccatgaatagcccacacaggtaccggctctcagagggtccgtgcattcctgctctccggacccccaaagggcccagcattggtgggtgcaccagtatcttagtgaccctcggagcaaattatccacaaaggatttgcattacgtcactcgaaacgttttcatccatgcttagcatctactctgtataacgcatgagaggggaggcaaagaagaaaaagacacacagaagggcctttaaaaaagtagatatttaatatctaagcaggggaggggacaggacagaaagcctgcactgaggggtgcggtgccaacagggaaactcttcacctccctgcaaacctaccagtgaggctcccagagacgcagctgtctcagtgccaggggcagattgggtgtgacctctccactcctccatctcctgctgttgtcctagtggctatcacaggcctgggtgggtgggttgggggaggtgtcagtcaccttgttggtaacactaaagttgttttgttggttttttaaaaacccaatactgaggttcttcctgttccctcaagttttcttatgggcttccaggctttaagctaattccagaagtaaaactgatcttgggtttcctattctgcctcccctagaagggcaggggtgataacccagctacagggaaatcccggcccagctttccacaggcatcacaggcatcttccgcggattctagggtgggctgcccagccttctggtctgaggcgcagctccctctgcccaggtgctgtgcctattcaagtggccttcaggcagagcagcaagtggcccttagcgccccttcccataagcagctgtggtggcagtgagggaggttgggtagccctggactggtcccctcctcagatcacccttgcaaatctggcctcatcttgtattccaacccgacatccctaaaagtacctccacccgttccgggtctggaaggcgttggcaccacaagcactgtccctgtgggaggagcacaaccttctcgggacaggatctgatggggtcttgggctaaaggaggtccctgctgtcctggagaaagtcctagaggttatctcaggaatgactggtggccctgccccaacgtggaaaggtgggaaggaagccttctcccattagccccaatgagagaactcaacgtgccggagctgagtgggccttgcacgagacactggccccactttcaggcctggaggaagcatgcacacatggagacggcgcctgcctgtagatgtttggatcttcgagatctccccaggcatcttgtctcccacaggatcgtgtgtgtaggtggtgttgtgtggttttcctttgtgaaggagagagggaaactatttgtagcttgttttataaaaaataaaaaatgggtaaatcttg

SEQ ID NO: 185168 - DNA, 3150 bp, Homo sapiens
  Payload ID: 16470
  Gene Symbol: SMOC2
  Gene Name: SPARC related modular calcium binding 2
  Uniprot ID: Q9H3U7
  ENST ID: ENST00000354536
  CDS Start-End: 221-1594
gggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagtctccttgcaaatcttttccgttctgaattcagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccacatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaactata

SEQ ID NO: 185169 - DNA, 3117 bp, Homo sapiens
  Payload ID: 16470
  Gene Symbol: SMOC2
  Gene Name: SPARC related modular calcium binding 2
  Uniprot ID: Q9H3U7
  ENST ID: ENST00000356284
  CDS Start-End: 221-1561
gggtatttgacaggagcgagggcggacgcaaagaacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccacatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaactata

SEQ ID NO: 185170 - DNA, 400 bp, Homo sapiens
  Payload ID: 16470
  Gene Symbol: SMOC2
  Gene Name: SPARC related modular calcium binding 2
  ENST ID: ENST00000392100
  CDS Start-End: 1-204
ggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacagaagtaagagaaacctgtgatggccagagcccagatgttcttaggaggcaagccaggagaagccgggtctgacttttcagctcagagacagcactcccccagaggtcatgctgaaagtacgtctaatagacagccaaggaaacaaggataaatggctcataccccgaaggcagttcctagacacatgggaaatttccctcaccaaagagcaattaa

SEQ ID NO: 185171 - DNA, 672 bp, Homo sapiens
  Payload ID: 16470
  Gene Symbol: SMOC2
  Gene Name: SPARC related modular calcium binding 2
  ENST ID: ENST00000417208
  CDS Start-End: 1-255
aaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacaggatgcaatggtggtgtcctccagacccaaagccacaacccatcgcaagtcaagaacactttccagaagataaacatgagtgggttcatgtctctctccttcaaagccaggacaaaatccccacttctttgctgccgcgagtcaatttgtgatttattttgtctgcacctgtttgatgccaggtcgacatttcctaaggcaagcccctgtatttgttgtggatttaagtggaggcggccagcacacaccttggatgtaatttaaaaccatttcctgaggaaagatgtgtgatatgctttcctttgtttagcaaatgtttatggttttaactttaaatctcaccgcaaatcacttacacttgaaaacagggctggtctgaaagtaattaccctccctgagtgccaagacctccagaagttgttttcattcccgaatggcaatcactgtactcatgcgctccacgcatcttaaataaactcagttcaaagca

SEQ ID NO: 185172 - DNA, 1875 bp, Homo sapiens
  Payload ID: 16470
  Gene Symbol: SMOC2
  Gene Name: SPARC related modular calcium binding 2
  ENST ID: ENST00000535039
  CDS Start-End: 1036-1446
cagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccacatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggggtgccgggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaact

SEQ ID NO: 185173 - DNA, 4488 bp, Homo sapiens
  Payload ID: 16471
  Gene Symbol: SPOCK1
  Gene Name: sparc/osteonectin, cwcv and kazal-like domains proteoglycan (testican) 1
  ENST ID: ENST00000282223
  CDS Start-End: 1-1134
gatgattatttcagaaactggaatcccaacaagccctttgaccaagccctggacccatccaaggacccctgcctgaaggtaaaatgcagccctcacaaagtgtgtgtgacccaggactaccagaccgccctgtgtgtcagccgcaagcacctgctccccaggcaaaagaaggggaacgtggcccagaaacactgggttggaccttcgaatttggtcaagtgcaagccctgtcccgtggcacagtcagccatggtctgcggctcagatggccactcctacacatccaagtgcaaattggagttccatgcttgttctactggcaaaagcctcgccaccctctgtgatgggccctgtccctgtctcccagagcctgagccaccaaagcacaaggcagaaaggagtgcctgcacagacaaggagttgcggaaccttgcctcccggctgaaggattggtttggagctctccacgaggatgcgaacagagtcatcaagcccaccagctccaacacagcccaaggcaggtttgacactagcatcctgcccatctgcaaggactccctgggctggatgttcaacaagttggacatgaactatgacctcctgcttgacccttcagagatcaatgccatctacctggataagtacgagccctgtatcaagcctcttttcaactcgtgtgactccttcaaggatggcaagctttctaacaatgagtggtgctactgcttccagaagcctggaggtctcccttgccagaatgaaatgaacagaattcagaagctgagtaaggggaaaagcctgttgggggccttcatacctcggtgtaatgaggagggctattacaaagccacacagtgccacggcagcacggggcagtgctggtgtgtggacaaatatgggaatgagttggctggctccaggaaacagggtgctgtgagctgtgaagaggagcaggaaacctcaggggattttggcagtggtgggtccgtggtcctgctggatgacctagaatatgaacgggagctgggaccaaaggacaaagaggggaagctgagggtgcacacccgagccgtgacagaggatgatgaggatgaggatgatgacaaagaggatgaggtcgggtacatatggtagtgcccacaagaaagaggacacaagttttgcacaaaattgcaagtcacttcctattcctgcatttgtatctaagactccaaggcaccaaggtctcttctccattgttgctctctatacccgacctaaggtttggaagacaactgcttgttcccagaggattctgattttgcatatgtttgtatgggagaaagggtgttgtgttttttttttgttgttgtttattttttggatagggaagtcattggcttaattagagcctccttcctttctgtgagatttttccaacaagcatgtgatttacgtggaattctgacagtgcagggagccccaaccctcttaaatgtcaaagaccctttttgattacccacactggtggttattacagcatggttcccagccttacagtgtctaagtgcttctcttgtgtcctgtagatgttgtgaaaaagaaaaaaacaaaaaatacaccacactgtactttttccccctgcccccgttactgccggtgattattattaaaaattagtttttttcacatcattatatctggcttcctataaacaacagccttaattcagtcaagactccctttggggaattcattttattaaaaattggtgtctggatacttccctgtacatgcataaatatgcatgcatgtacagaaagactgtatgtgtgtgccttgcacacacacccatacctctcagaaaaagtgtttgggtatcttaaaaactcgaaaaacaatgataaatttctcagcttgtccagacctggaacaaaatttctggaataagaaatttgtattaaagtccttttttgcactaacagttggctcttgtagcctgcaggctgaggaagtctcttctctgtgcatcagcagagttactgaaagcctctgattgagaaaaaacctccgtctgcctaaatcacttttctcgcagaagccatgcgactcccacacgacacgggcagcttcacaagccatctctttcatttctgcttgaagccccttggctgcagcaatcctgtctgccataggtttcttccttccttacctactcaagggctttttctaaggcatgcacacatatctcctgttctctgagagtaccatggtgttccttaaaagaagaaaatttctaattctgaactcaatgttttgcttttactccctttctactgacaaatcatgataagggcacaaaagctgtacagatttttttttttaaccactcaatcccaaatggaggcctacaaagaacatcgtaataacacatggaagcaaaccctgggtttttaagagcaaattctgtccccccctcactcccccaagtgacaagatactaatgaagaaagttcttcaccatagtgtttgttttaactaaactcattggagtctagttccaaatttggtagggtcatcatctctacattccttaggatttctctccctatcaagctggcccagatacaagtaccaaacagtagtctctgaagttcccccatttccttcagtaccagtctataagctactgtccgccactgattttcatttatcagggtgtcctaatcagaatcagccacccaagcaagcctctctggcccacatatctatctcttgccttcccccatgaacttcagcctgtccacacaaaagccacataaactcaagcaagaaatatgttcagccaaaacatgattatagtggcagctgaccaatcccccatcccaaattgaccatttagatgtaccaactcaccttaaattagcatgttccaatccagtcggcattgcctgaatacagtagcatcatacctatagttggtcttagataagaaatgaactacttgatatagcaaagtcctttggcttcgtaaataaccctgaggttttgtacttactttccccataggaagacagaccataggcaaactctgttttgggatctcaactccatcacctttgtttcaatattttttttctctcttgaacaaaactgagataatttagaaaacaggtgcttaattgcaataaaattactatgaagtatattaaaaatcacgacattgtaaaatctcactttagatcatcaaagaaaaccattgttactatctcctttgagcttaggaaaatgtacaagagaacaaattaaaattgaaaaattgatttcacttagaaaaacttctaggaacagggtgaaccactgattttaatttgcctaattatcttatgacaagtatcaaattaagatgacacttaaagatccttagcattaacttaatgatggagaagagtgctcaatagacagttcccagtaaggtaatgagatgccattttcagagacattctaagaagatattttgattcattaaaacattaaataaaaagccctcctcagattggaacccccaaatcgatggagccacattaataatacttttcatgcctcactttgacatgacagcattcgatttttttaaagatctttaatactttccatgagtactaaagattgtaatgagttaccttatccttagaagtagaatgtttgctttcttcttcttggaaatagtcctccaaaaagtccacttgtaccagtgacaagaagtcacttgtatagtgaccaagtacacataaaatactgattataaaaatattgtaataaaccacttcctcatttgatacaggtattaagctgaatcctcactaattcacttttgaaaagttcttaatgaacagttttattcttattccatgaacagctcttttaatacaatttccttggtatccaacttaaatcccagaattttgttccaccatggttagttatttgccatatgaatgtattcttgtttctaccaatattctaggcatgagaataccttaatactgagttggagattttgtatctgtttctcctcctttacgcccattttcctacccacagcagcaaatgacaacgtgtctgtccaggtctgtccccctgctcatcccaggatgccactcacatttttttcttcttgttaccttgaccacgctgtacagtaacatccaagagcccattctacagtgggtggttttggtctttttataactttttctcaaagtcactgatgtttgttcctgttaaatgtatagcattgtaatgagagcccatcaaatcctgagtgtcagtttgttgtccctattgtagatgaaatagtgatgtagcaaaaacctagtaaattctgaatgcttttccacgtagacttatctggaatgtgaacacaactctttggttaatagtaaatgcttaactgtagtcctgagtaggtgcatttctgtctgtctcaataaattttactttgtctgc

SEQ ID NO: 185174 - DNA, 4846 bp, Homo sapiens
  Payload ID: 16471
  Gene Symbol: SPOCK1
  Gene Name: sparc/osteonectin, cwcv and kazal-like domains proteoglycan (testican) 1
  Uniprot ID: Q08629
  ENST ID: ENST00000394945
  CDS Start-End: 171-1490
cgagccagcgagcgagcagagcacatcgctgcgggctcacaaagcggccagacgctcggcggcggcgtgtggcaggagcgcaggggcgcgagccggcgatcagccttcccggcgaccgtgccgcgggagctcgagcaactcggactaggggacccgggccggcccccaagatgccggcgatcgcggtgttggcggcggccgccgcggcgtggtgcttcctccaagtcgagagccggcacctggacgcgctcgccggaggcgcgggccccaaccacggcaatttcctagacaatgaccagtggctgagcaccgtctcccagtacgaccgggacaagtactggaaccgctttcgagacgatgattatttcagaaactggaatcccaacaagccctttgaccaagccctggacccatccaaggacccctgcctgaaggtaaaatgcagccctcacaaagtgtgtgtgacccaggactaccagaccgccctgtgtgtcagccgcaagcacctgctccccaggcaaaagaaggggaacgtggcccagaaacactgggttggaccttcgaatttggtcaagtgcaagccctgtcccgtggcacagtcagccatggtctgcggctcagatggccactcctacacatccaagtgcaaattggagttccatgcttgttctactggcaaaagcctcgccaccctctgtgatgggccctgtccctgtctcccagagcctgagccaccaaagcacaaggcagaaaggagtgcctgcacagacaaggagttgcggaaccttgcctcccggctgaaggattggtttggagctctccacgaggatgcgaacagagtcatcaagcccaccagctccaacacagcccaaggcaggtttgacactagcatcctgcccatctgcaaggactccctgggctggatgttcaacaagttggacatgaactatgacctcctgcttgacccttcagagatcaatgccatctacctggataagtacgagccctgtatcaagcctcttttcaactcgtgtgactccttcaaggatggcaagctttctaacaatgagtggtgctactgcttccagaagcctggaggtctcccttgccagaatgaaatgaacagaattcagaagctgagtaaggggaaaagcctgttgggggccttcatacctcggtgtaatgaggagggctattacaaagccacacagtgccacggcagcacggggcagtgctggtgtgtggacaaatatgggaatgagttggctggctccaggaaacagggtgctgtgagctgtgaagaggagcaggaaacctcaggggattttggcagtggtgggtccgtggtcctgctggatgacctagaatatgaacgggagctgggaccaaaggacaaagaggggaagctgagggtgcacacccgagccgtgacagaggatgatgaggatgaggatgatgacaaagaggatgaggtcgggtacatatggtagtgcccacaagaaagaggacacaagttttgcacaaaattgcaagtcacttcctattcctgcatttgtatctaagactccaaggcaccaaggtctcttctccattgttgctctctatacccgacctaaggtttggaagacaactgcttgttcccagaggattctgattttgcatatgtttgtatgggagaaagggtgttgtgttttttttttgttgttgtttattttttggatagggaagtcattggcttaattagagcctccttcctttctgtgagatttttccaacaagcatgtgatttacgtggaattctgacagtgcagggagccccaaccctcttaaatgtcaaagaccctttttgattacccacactggtggttattacagcatggttcccagccttacagtgtctaagtgcttctcttgtgtcctgtagatgttgtgaaaaagaaaaaaacaaaaaatacaccacactgtactttttccccctgcccccgttactgccggtgattattattaaaaattagtttttttcacatcattatatctggcttcctataaacaacagccttaattcagtcaagactccctttggggaattcattttattaaaaattggtgtctggatacttccctgtacatgcataaatatgcatgcatgtacagaaagactgtatgtgtgtgccttgcacacacacccatacctctcagaaaaagtgtttgggtatcttaaaaactcgaaaaacaatgataaatttctcagcttgtccagacctggaacaaaatttctggaataagaaatttgtattaaagtccttttttgcactaacagttggctcttgtagcctgcaggctgaggaagtctcttctctgtgcatcagcagagttactgaaagcctctgattgagaaaaaacctccgtctgcctaaatcacttttctcgcagaagccatgcgactcccacacgacacgggcagcttcacaagccatctctttcatttctgcttgaagccccttggctgcagcaatcctgtctgccataggtttcttccttccttacctactcaagggctttttctaaggcatgcacacatatctcctgttctctgagagtaccatggtgttccttaaaagaagaaaatttctaattctgaactcaatgttttgcttttactccctttctactgacaaatcatgataagggcacaaaagctgtacagatttttttttttaaccactcaatcccaaatggaggcctacaaagaacatcgtaataacacatggaagcaaaccctgggtttttaagagcaaattctgtccccccctcactcccccaagtgacaagatactaatgaagaaagttcttcaccatagtgtttgttttaactaaactcattggagtctagttccaaatttggtagggtcatcatctctacattccttaggatttctctccctatcaagctggcccagatacaagtaccaaacagtagtctctgaagttcccccatttccttcagtaccagtctataagctactgtccgccactgattttcatttatcagggtgtcctaatcagaatcagccacccaagcaagcctctctggcccacatatctatctcttgccttcccccatgaacttcagcctgtccacacaaaagccacataaactcaagcaagaaatatgttcagccaaaacatgattatagtggcagctgaccaatcccccatcccaaattgaccatttagatgtaccaactcaccttaaattagcatgttccaatccagtcggcattgcctgaatacagtagcatcatacctatagttggtcttagataagaaatgaactacttgatatagcaaagtcctttggcttcgtaaataaccctgaggttttgtacttactttccccataggaagacagaccataggcaaactctgttttgggatctcaactccatcacctttgtttcaatattttttttctctcttgaacaaaactgagataatttagaaaacaggtgcttaattgcaataaaattactatgaagtatattaaaaatcacgacattgtaaaatctcactttagatcatcaaagaaaaccattgttactatctcctttgagcttaggaaaatgtacaagagaacaaattaaaattgaaaaattgatttcacttagaaaaacttctaggaacagggtgaaccactgattttaatttgcctaattatcttatgacaagtatcaaattaagatgacacttaaagatccttagcattaacttaatgatggagaagagtgctcaatagacagttcccagtaaggtaatgagatgccattttcagagacattctaagaagatattttgattcattaaaacattaaataaaaagccctcctcagattggaacccccaaatcgatggagccacattaataatacttttcatgcctcactttgacatgacagcattcgatttttttaaagatctttaatactttccatgagtactaaagattgtaatgagttaccttatccttagaagtagaatgtttgctttcttcttcttggaaatagtcctccaaaaagtccacttgtaccagtgacaagaagtcacttgtatagtgaccaagtacacataaaatactgattataaaaatattgtaataaaccacttcctcatttgatacaggtattaagctgaatcctcactaattcacttttgaaaagttcttaatgaacagttttattcttattccatgaacagctcttttaatacaatttccttggtatccaacttaaatcccagaattttgttccaccatggttagttatttgccatatgaatgtattcttgtttctaccaatattctaggcatgagaataccttaatactgagttggagattttgtatctgtttctcctcctttacgcccattttcctacccacagcagcaaatgacaacgtgtctgtccaggtctgtccccctgctcatcccaggatgccactcacatttttttcttcttgttaccttgaccacgctgtacagtaacatccaagagcccattctacagtgggtggttttggtctttttataactttttctcaaagtcactgatgtttgttcctgttaaatgtatagcattgtaatgagagcccatcaaatcctgagtgtcagtttgttgtccctattgtagatgaaatagtgatgtagcaaaaacctagtaaattctgaatgcttttccacgtagacttatctggaatgtgaacacaactctttggttaatagtaaatgcttaactgtagtcctgagtaggtgcatttctgtctgtctcaataaattttactttgtctgcaa

SEQ ID NO: 185175 - DNA, 571 bp, Homo sapiens
  Payload ID: 16471
  Gene Symbol: SPOCK1
  Gene Name: sparc/osteonectin, cwcv and kazal-like domains proteoglycan (testican) 1
  ENST ID: ENST00000510689
  CDS Start-End: 371-571
agacgctcggcggcggcgtgtggcaggagcgcaggggcgcgagccggcgatcagccttcccggcgaccgtgccgcgggagctcgagcaactcggactaggggacccgggccggcccccaaggatgattatttcagaaactggaatcccaacaagccctttgaccaagccctggacccatccaaggacccctgcctgaaggtaaaatgcagccctcacaaagtgtgtgtgacccaggactaccagaccgccctgtgtgtcagccgcaagcacctgctccccaggcaaaagaaggggaacgtggcccagaaacactgggttggaccttcgaatttggtcaagtgcaagccctgtcccgtggcacagtcagccatggtctgcggctcagatggccactcctacacatccaagtgcaaattggagttccatgcttgttctactggcaaaagcctcgccaccctctgtgatgggccctgtccctgtctcccagagcctgagccaccaaagcacaaggcagaaaggagtgcctgcacagacaaggagttgcggaaccttgcctcccggctgaaggat

SEQ ID NO: 185176 - DNA, 453 bp, Homo sapiens
  Payload ID: 16471
  Gene Symbol: SPOCK1
  Gene Name: sparc/osteonectin, cwcv and kazal-like domains proteoglycan (testican) 1
  ENST ID: ENST00000505690
  CDS Start-End: 37-453
ctcttcgctcatcgccctgcgcgccctgccccgcagatgccggcgatcgcggtgttggcggcggccgccgcggcgtggtgcttcctccaagtcgagagccggcacctggacgcgctcgccggaggcgcgggccccaaccacggcaatttcctagacaatgaccagtggctgagcaccgtctcccagtacgaccgggacaagtactggaaccgctttcgagacgatgattatttcagaaactggaatcccaacaagccctttgaccaagccctggacccatccaaggacccctgcctgaaggtaaaatgcagccctcacaaagtgtgtgtgacccaggactaccagaccgccctgtgtgtcagccgcaagcacctgctccccaggcaaaagaaggggaacgtggcccagaaacactgggttggaccttcgaatttggtcaagtgcaagccctgt

SEQ ID NO: 185177 - DNA, 5328 bp, Homo sapiens
  Payload ID: 16472
  Gene Symbol: SPOCK2
  Gene Name: sparc/osteonectin, cwcv and kazal-like domains proteoglycan (testican) 2
  Uniprot ID: Q92563
  ENST ID: ENST00000317376
  CDS Start-End: 329-1603
agttgttatacggcttttgtcttaacgaagccacccattacggtatgatgatgtcaaacgtgatgctgatgctacagttacagcccctgctggcgcagcctctctgattctctctccctctccgcgtccagtgctgggctttttcagacaagtgcatctcctaaccaggtcacatttcagccgcgacccactctccgccagtcaccggaggcagaccgcgggaggagagctgaggacagccgcgtgcgcttcgccagcagcggggtgggaggaaggacattaaaatactgcagaagtcaagacccccccaggtcgaacccagaccacgatgcgcgccccgggctgcgggcggctggtgctgccgctgctgctcctggccgcggcagccctggccgaaggcgacgccaaggggctcaaggagggcgagacccccggcaatttcatggaggacgagcaatggctgtcgtccatctcgcagtacagcggcaagatcaagcactggaaccgcttccgagacgaagtggaggatgactatatcaagagctgggaggacaatcagcaaggagatgaagccctggataccaccaaggacccctgccagaaggtgaagtgcagccgccacaaggtgtgcattgcccagggctaccagcgggccatgtgcatcagtcgcaagaagctggagcacaggatcaagcagccgaccgtgaaactccatggaaacaaagactccatctgcaagccctgccacatggcccagcttgcctctgtctgcggctcagatggccacacttacagctctgtgtgtaagctggagcaacaggcgtgcctgagcagcaagcagctggcggtgcgatgcgagggcccctgcccctgccccacggagcaggctgccacctccaccgccgatggcaaaccagagacttgcaccggtcaggacctggctgacctgggagatcggctgcgggactggttccagctccttcatgagaactccaagcagaatggctcagccagcagtgtagccggcccggccagcgggctggacaagagcctgggggccagctgcaaggactccattggctggatgttctccaagctggacaccagtgctgacctcttcctggaccagacggagctggccgccatcaacctggacaagtacgaggtctgcatccgtcccttcttcaactcctgtgacacctacaaggatggccgggtctctactgctgagtggtgcttctgcttctggagggagaagcccccctgcctggcagagctggagcgcatccagatccaggaggccgccaagaagaagccaggcatcttcatcccgagctgcgacgaggatggctactaccggaagatgcagtgtgaccagagcagcggtgactgctggtgtgtggaccagctgggcctggagctgactggcacgcgcacgcatgggagccccgactgcgatgacatcgtgggcttctcgggggactttggaagcggtgtcggctgggaggatgaggaggagaaggagacggaggaagcaggcgaggaggccgaggaggaggagggcgaggcaggcgaggctgacgacgggggctacatctggtagacgccctcaggagccggctgccgggggggactcaacagcagagctctgagcagcagcaggcaacttcgagaacggatccagaaatgcagtcagaaggaccctgctccacctggggggactgggagtgtgagtgtgcatggcatgtgtgtggcacagatggctgggacgggtgacagtgtgagtgcatgtgtgcatgcatgtgtgtatgtgtgtgtgtgtgtggcatgcgctgacaaatgtgtccttgatccacactgctcctggcagagtgagtcacccaaaggccccttcggcctccttgtagctgttttctttccttttgttgttggttttaaaatacattcacacacaaatacaaattgacaggtcaaaatccatgaaatgagatcccccagccgtgtcctccagcccagccctgaccccttggtttctaccctggctccccttggtttctaccctggctcaaccgacccctgtctgcccttctccctcttgcttctgaggtcaagctctggcctgcgagcctgtccccattgcaaaggggagggaggggcagggagctgtctaccagctgaggtcctcccaaaactgggccgatgtggtgtgacatccccaccagcctcagatgagacgggccaggacgcccagccacagcaagccctgtccctttgccggatccccaaacactagagaagctctcctaacccaaggcggagaatgaaggtggtggcggcagaggaggagggcagcagctgagaggccagggacagggtgcctcgccaagctgtctgaggtctgtcccaggtggcccaggtggtgcaggtagaacagggtgaggagagggggtcggctcagcaggaggaggctgtggctgcagagcctgggggagcttttaggtgttgagatggggcagctctgaatcctagaccctggaatagcctgtcccttttctctgggtctcgtggtggagccatgatctgggctgctctcttggggacactgggtggtggttacacagttgacctctgcctggctcccccttggtgcaactcctgcctccatcccccttgctggggtcccctcatccacttgagggcgcctgagggccaggagcagcaggcaaggagcctgggtctaggctaagggggtgtgtgcccacctcctccctgacccttaacactcctgtcctgcccagaccaacagagagagctgtccctgagaccccggagagaagcagctgccgaaagctgcagcctttccgcactctgagaccatgatcttcctcctgccaggggagagccacccacaggccatgtccagccccacttccctcagcccccagggcttccttctggcccctctgaggattccctagggctgccccgcagaggggcttccccaagctctgttttgaagcctgcaatgtggaaaagtgagaagtcagagggaacaggacaggtgcagccgggctctgaggccacacctcacacctcgctgttccccaacatcccctgagcagtgtgagctcatctcaccagatgagaagaggccctgtgcatttcttttgtttgtttgttgctgttttcccccacccatccagttctcctcagcaaagcaaattccttaacacctttggtggagaatttcttacccagacttggggctgtgatgcccttcagtgcgtggtgagtgcagcgtgtgtgcgtgtgcctgtgtgtgaacctgggggccatcctggtggcctgggagcgtgaggagaggccccctgtgtgctgggtgagtggtgggtgtggggtcaatgcagtgaggctctctgggtgaggctcccaacctggcagtccccagcctcccagcatctgtgagcgtctgttggactttacagaagagcctcatcctgtctgcccctcactctgccctggaatcaacatcttccgagtccttcttgggggaaatagcagagccccacttaactccataaactgcttcccattccgcagcccagttctgattgttgaggtgtcgcgtcgttccaggtcccccagtcccctctttctcctgtcctctctctgtccttcacctccccactccagccccggctcagttcagggaaatgctgttccacatcagccctctgctctctgaggcagccgcgcctctgactcggagctacttgaaacttctgctcttgctaggattggagtctacctatctcttccatttgtcccagctggagttctggaactttcctcctcggggtgggggtgggggttgttaaggatgctggggggcctggggaaggaaggagttcagaggaagggtgtcccctgtcctcttgatgtcaccctccgctcctgggacacgtgctctctctgtctctgggtcttctggctgtgcacgtttgtgtgtccttgtaaatatgttttaggaagaaagcaaaagggactgaactagcctctggtaggattgcaggggtccagccttgcctgtttccgaagcccccacactgcctttcgccctactgagactggtcccctcaaaaggtagacaaaacagcagctccctgtggagctgaagggcggcctcaaagtggctttttgttagacaaggttaaggtttcctcatgagcaaggttgcagatcggtccttcctcagctccttgatttgtgaccttgaccaaggggcctgccacccagcccctccagtgccctctcctcgatgcctcgctccttcctgcccccactcccctggcttaggcaggtaggggaattagggccatgctggaagaagcttaaccatgtgttcaaagaacggtttcttgcttgcttggtcctggaactccccttggctgccccaggcctccttggcccatgggtgctgggggaggtggatgtcagatctggtaggttgcagcagagaaaataaatgtgccttgagagaccactcagagagggtccaagggtgatggagaaggaagcatggcctgggagcttggaagggaggggtggtgggtggcggcatcttgactgccccctgttgtcccacacgtggggggtggtcaccccccttcactccagcccgcctgccttcagccttccatgagcttcacctgcttccaacttcactttggagggggtggggtccgttggcatcaacacggggaccctctgcttcaccaaagcccgagccctcagcccctggggagaacaaatggctgagctttgatacctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgccccgcctccacttggggaccctgcctcgtgtcgtctttatctgcctattactcagcctaaggaaacaagtacactccacacatgcataaaggaaatcaaatgttatttttaagaaaatggaaaataaaaactttataaacacc

SEQ ID NO: 185178 - DNA, 5445 bp, Homo sapiens
  Payload ID: 16472
  Gene Symbol: SPOCK2
  Gene Name: sparc/osteonectin, cwcv and kazal-like domains proteoglycan (testican) 2
  Uniprot ID: Q92563
  ENST ID: ENST00000373109
  CDS Start-End: 446-1720
cagggacatttcgggattctggatttcttggtctgcaactccctgtgtgccaggcggggctgggccccgctgcggctggctggcgtttggcgctctcatcgagggagcgcttcgctttgaaatctacccactccttttttttttttttttttaaaccaggtatgatgatgtcaaacgtgatgctgatgctacagttacagcccctgctggcgcagcctctctgattctctctccctctccgcgtccagtgctgggctttttcagacaagtgcatctcctaaccaggtcacatttcagccgcgacccactctccgccagtcaccggaggcagaccgcgggaggagagctgaggacagccgcgtgcgcttcgccagcagcggggtgggaggaaggacattaaaatactgcagaagtcaagacccccccaggtcgaacccagaccacgatgcgcgccccgggctgcgggcggctggtgctgccgctgctgctcctggccgcggcagccctggccgaaggcgacgccaaggggctcaaggagggcgagacccccggcaatttcatggaggacgagcaatggctgtcgtccatctcgcagtacagcggcaagatcaagcactggaaccgcttccgagacgaagtggaggatgactatatcaagagctgggaggacaatcagcaaggagatgaagccctggataccaccaaggacccctgccagaaggtgaagtgcagccgccacaaggtgtgcattgcccagggctaccagcgggccatgtgcatcagtcgcaagaagctggagcacaggatcaagcagccgaccgtgaaactccatggaaacaaagactccatctgcaagccctgccacatggcccagcttgcctctgtctgcggctcagatggccacacttacagctctgtgtgtaagctggagcaacaggcgtgcctgagcagcaagcagctggcggtgcgatgcgagggcccctgcccctgccccacggagcaggctgccacctccaccgccgatggcaaaccagagacttgcaccggtcaggacctggctgacctgggagatcggctgcgggactggttccagctccttcatgagaactccaagcagaatggctcagccagcagtgtagccggcccggccagcgggctggacaagagcctgggggccagctgcaaggactccattggctggatgttctccaagctggacaccagtgctgacctcttcctggaccagacggagctggccgccatcaacctggacaagtacgaggtctgcatccgtcccttcttcaactcctgtgacacctacaaggatggccgggtctctactgctgagtggtgcttctgcttctggagggagaagcccccctgcctggcagagctggagcgcatccagatccaggaggccgccaagaagaagccaggcatcttcatcccgagctgcgacgaggatggctactaccggaagatgcagtgtgaccagagcagcggtgactgctggtgtgtggaccagctgggcctggagctgactggcacgcgcacgcatgggagccccgactgcgatgacatcgtgggcttctcgggggactttggaagcggtgtcggctgggaggatgaggaggagaaggagacggaggaagcaggcgaggaggccgaggaggaggagggcgaggcaggcgaggctgacgacgggggctacatctggtagacgccctcaggagccggctgccgggggggactcaacagcagagctctgagcagcagcaggcaacttcgagaacggatccagaaatgcagtcagaaggaccctgctccacctggggggactgggagtgtgagtgtgcatggcatgtgtgtggcacagatggctgggacgggtgacagtgtgagtgcatgtgtgcatgcatgtgtgtatgtgtgtgtgtgtgtggcatgcgctgacaaatgtgtccttgatccacactgctcctggcagagtgagtcacccaaaggccccttcggcctccttgtagctgttttctttccttttgttgttggttttaaaatacattcacacacaaatacaaattgacaggtcaaaatccatgaaatgagatcccccagccgtgtcctccagcccagccctgaccccttggtttctaccctggctccccttggtttctaccctggctcaaccgacccctgtctgcccttctccctcttgcttctgaggtcaagctctggcctgcgagcctgtccccattgcaaaggggagggaggggcagggagctgtctaccagctgaggtcctcccaaaactgggccgatgtggtgtgacatccccaccagcctcagatgagacgggccaggacgcccagccacagcaagccctgtccctttgccggatccccaaacactagagaagctctcctaacccaaggcggagaatgaaggtggtggcggcagaggaggagggcagcagctgagaggccagggacagggtgcctcgccaagctgtctgaggtctgtcccaggtggcccaggtggtgcaggtagaacagggtgaggagagggggtcggctcagcaggaggaggctgtggctgcagagcctgggggagcttttaggtgttgagatggggcagctctgaatcctagaccctggaatagcctgtcccttttctctgggtctcgtggtggagccatgatctgggctgctctcttggggacactgggtggtggttacacagttgacctctgcctggctcccccttggtgcaactcctgcctccatcccccttgctggggtcccctcatccacttgagggcgcctgagggccaggagcagcaggcaaggagcctgggtctaggctaagggggtgtgtgcccacctcctccctgacccttaacactcctgtcctgcccagaccaacagagagagctgtccctgagaccccggagagaagcagctgccgaaagctgcagcctttccgcactctgagaccatgatcttcctcctgccaggggagagccacccacaggccatgtccagccccacttccctcagcccccagggcttccttctggcccctctgaggattccctagggctgccccgcagaggggcttccccaagctctgttttgaagcctgcaatgtggaaaagtgagaagtcagagggaacaggacaggtgcagccgggctctgaggccacacctcacacctcgctgttccccaacatcccctgagcagtgtgagctcatctcaccagatgagaagaggccctgtgcatttcttttgtttgtttgttgctgttttcccccacccatccagttctcctcagcaaagcaaattccttaacacctttggtggagaatttcttacccagacttggggctgtgatgcccttcagtgcgtggtgagtgcagcgtgtgtgcgtgtgcctgtgtgtgaacctgggggccatcctggtggcctgggagcgtgaggagaggccccctgtgtgctgggtgagtggtgggtgtggggtcaatgcagtgaggctctctgggtgaggctcccaacctggcagtccccagcctcccagcatctgtgagcgtctgttggactttacagaagagcctcatcctgtctgcccctcactctgccctggaatcaacatcttccgagtccttcttgggggaaatagcagagccccacttaactccataaactgcttcccattccgcagcccagttctgattgttgaggtgtcgcgtcgttccaggtcccccagtcccctctttctcctgtcctctctctgtccttcacctccccactccagccccggctcagttcagggaaatgctgttccacatcagccctctgctctctgaggcagccgcgcctctgactcggagctacttgaaacttctgctcttgctaggattggagtctacctatctcttccatttgtcccagctggagttctggaactttcctcctcggggtgggggtgggggttgttaaggatgctggggggcctggggaaggaaggagttcagaggaagggtgtcccctgtcctcttgatgtcaccctccgctcctgggacacgtgctctctctgtctctgggtcttctggctgtgcacgtttgtgtgtccttgtaaatatgttttaggaagaaagcaaaagggactgaactagcctctggtaggattgcaggggtccagccttgcctgtttccgaagcccccacactgcctttcgccctactgagactggtcccctcaaaaggtagacaaaacagcagctccctgtggagctgaagggcggcctcaaagtggctttttgttagacaaggttaaggtttcctcatgagcaaggttgcagatcggtccttcctcagctccttgatttgtgaccttgaccaaggggcctgccacccagcccctccagtgccctctcctcgatgcctcgctccttcctgcccccactcccctggcttaggcaggtaggggaattagggccatgctggaagaagcttaaccatgtgttcaaagaacggtttcttgcttgcttggtcctggaactccccttggctgccccaggcctccttggcccatgggtgctgggggaggtggatgtcagatctggtaggttgcagcagagaaaataaatgtgccttgagagaccactcagagagggtccaagggtgatggagaaggaagcatggcctgggagcttggaagggaggggtggtgggtggcggcatcttgactgccccctgttgtcccacacgtggggggtggtcaccccccttcactccagcccgcctgccttcagccttccatgagcttcacctgcttccaacttcactttggagggggtggggtccgttggcatcaacacggggaccctctgcttcaccaaagcccgagccctcagcccctggggagaacaaatggctgagctttgatacctggggtcgtcgagaggctgcgggctggcggcagtcccaggggagagacaccacagaaggagacccagacatcccgaggaagttcccagcagagcaaactgctttccagcctgaagcctgcttaaactgtgtgatgtgcaataactgagcttagagttaggaattgtgttcaagtgcttggatttccgtctgtagatttaactgctgaaattgtatctctcagtaattttagatgtcttttaaaaaattgaaaaacaaagtgttagactgtgtgcgtgtgcgttgatgggcactcaagagtcccgtgagtcatccagccctgcctttcccctgcgcccccatcctctcacgtcccgccccgcctccacttggggaccctgcctcgtgtcgtctttatctgcctattactcagcctaaggaaacaagtacactccacacatgcataaaggaaatcaaatgttatttttaagaaaatggaaaataaaaactttataaacacc

SEQ ID NO: 185179 - DNA, 1284 bp, Homo sapiens
  Payload ID: 16472
  Gene Symbol: SPOCK2
  Gene Name: sparc/osteonectin, cwcv and kazal-like domains proteoglycan (testican) 2
  Uniprot ID: Q92563
  ENST ID: ENST00000412663
  CDS Start-End: 329-562
agttgttatacggcttttgtcttaacgaagccacccattacggtatgatgatgtcaaacgtgatgctgatgctacagttacagcccctgctggcgcagcctctctgattctctctccctctccgcgtccagtgctgggctttttcagacaagtgcatctcctaaccaggtcacatttcagccgcgacccactctccgccagtcaccggaggcagaccgcgggaggagagctgaggacagccgcgtgcgcttcgccagcagcggggtgggaggaaggacattaaaatactgcagaagtcaagacccccccaggtcgaacccagaccacgatgcgcgccccgggctgcgggcggctggtgctgccgctgctgctcctggccgcggcagccctggccgaaggcgacgccaaggggctcaaggagggcgagacccccggcaatttcatggaggacgagcaatggctgtcgtccatctcgcagtacagcggcaagatcaagcactggaaccgcttccgagacgttccctcgtccgacccacccagtacaacgcaggccacaccatgacctctcccgttttctccttaaactgcgtgcatccacaagttccttggaaatttgtttaaaacacacatgcttcataggctatccagccaagtgatgggaagaggcagagatttggatctttttgttaccgtcagacaagtgactgtttctccccaaagtcaaactggcaggttgtaattcacagaggacagcaggaaccacgggcagccaggtctccaggctgagtggccgggccccgcgatgggctgctgatctccgccttcgccccacatgcgacctgtccagccgcaggagcctggagccccgcgaggccttcccgaagcacctgcaggcccagcgcagatgagccgcagtctcctgccgcttcctgggcagcagcccggccacagcagcgagggggcggcagcaggccggcccatccggaatccatgtgtcactggcctaggcctccctccgactcgctggctgtttgatctgccaaaatgggaccagtgaaggtcagagggaaaagaaatgcttaatcagaacaggaaaggtttaaaataaaagattcctccccacctcccttcttccacctgcttccaatagccagctccgtgggtgagaataaatgacttactgcttgaccccatggcactgggctacccacctgtctctctgtattggtgccaaccacttcccccttcctctcatgctcatcagaagaaaggcactagatttga

SEQ ID NO: 185180 - DNA, 1824 bp, Homo sapiens
  Payload ID: 16472
  Gene Symbol: SPOCK2
  Gene Name: sparc/osteonectin, cwcv and kazal-like domains proteoglycan (testican) 2
  ENST ID: ENST00000536168
  CDS Start-End: 199-1470
gtgctgggctttttcagacaagtgcatctcctaaccaggtcacatttcagccgcgacccactctccgccagtcaccggaggcagaccgcgggaggagagctgaggacagccgcgtgcgcttcgccagcagcggggtgggaggaaggacattaaaatactgcagaagtcaagacccccccaggtcgaacccagaccacgatgcgcgccccgggctgcgggcggctggtgctgccgctgctgctcctggccgcggcagccctggccgaaggcgacgccaaggggctcaaggagggcgagacccccggcaatttcatggaggacgagcaatggctgtcgtccatctcgcagtacagcggcaagatcaagcactggaaccgcttccgagacgtgaaggatgactatatcaagagctgggaggacaatcagcaaggagatgaagccctggataccaccaaggacccctgccagaaggtgaagtgcagccgccacaaggtgtgcattgcccagggctaccagcgggccatgtgcatcagtcgcaagaagctggagcacaggatcaagcagccgaccgtgaaactccatggaaacaaagactccatctgcaagccctgccacatggcccagcttgcctctgtctgcggctcagatggccacacttacagctctgtgtgtaagctggagcaacaggcgtgcctgagcagcaagcagctggcggtgcgatgcgagggcccctgcccctgccccacggagcaggctgccacctccaccgccgatggcaaaccagagacttgcaccggtcaggacctggctgacctgggagatcggctgcgggactggttccagctccttcatgagaactccaagcagaatggctcagccagcagtgtagccggcccggccagcgggctggacaagagcctgggggccagctgcaaggactccattggctggatgttctccaagctggacaccagtgctgacctcttcctggaccagacggagctggccgccatcaacctggacaagtacgaggtctgcatccgtcccttcttcaactcctgtgacacctacaaggatggccgggtctctactgctgagtggtgcttctgcttctggagggagaagcccccctgcctggcagagctggagcgcatccagatccaggaggccgccaagaagaagccaggcatcttcatcccgagctgcgacgaggatggctactaccggaagatgcagtgtgaccagagcagcggtgactgctggtgtgtggaccagctgggcctggagctgactggcacgcgcacgcatgggagccccgactgcgatgacatcgtgggcttctcgggggactttggaagcggtgtcggctgggaggatgaggaggagaaggagacggaggaagcaggcgaggaggccgaggaggaggagggcgaggcaggcgaggctgacgacgggggctacatctggtagacgccctcaggagccggctgccgggggggactcaacagcagagctctgagcagcagcaggcaacttcgagaacggatccagaaatgcagtcagaaggaccctgctccacctggggggactgggagtgtgagtgtgcatggcatgtgtgtggcacagatggctgggacgggtgacagtgtgagtgcatgtgtgcatgcatgtgtgtatgtgtgtgtgtgtgtggcatgcgctgacaaatgtgtccttgatccacactgctcctggcagagtgagtcacccaaaggccccttcggcctccttgtagctgttttctttccttttgttgttggttttaaaatacattcacacacaaat

SEQ ID NO: 185181 - DNA, 2986 bp, Homo sapiens
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENST ID: ENST00000357154
  CDS Start-End: 139-1449
gggagcgcgccgggcgcagggagctgagtggacggctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgaagtagaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaaccaaa

SEQ ID NO: 185182 - DNA, 2936 bp, Homo sapiens
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENST ID: ENST00000357545
  CDS Start-End: 101-1402
gagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaacc

SEQ ID NO: 185183 - DNA, 3061 bp, Homo sapiens
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENST ID: ENST00000421836
  CDS Start-End: 367-1524
ggggggagcgcgccgggcgcagggagctgagtggacggctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagactaagaagaaaaacgattatttgacaggacagtagtgatgatcacacaagatcacatccacatgtcttctgggctcagtcaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaaccaaa

SEQ ID NO: 185184 - DNA, 2947 bp, Homo sapiens
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENST ID: ENST00000506886
  CDS Start-End: 104-1414
acaaagcagataaggattcctaggctaggagctacctcgtcctctggctccagccaagcgtcctatccggagccaactgtagctgggatccagcgagaggaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgaagtagaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaac

SEQ ID NO: 185185 - DNA, 1032 bp, Homo sapiens
  Payload ID: 16473
  Gene Symbol: SPOCK3
  Gene Name: sparc/osteonectin, cwcv and kazal-like domains proteoglycan (testican) 3
  ENST ID: ENST00000507086
  CDS Start-End: 114-482
gagtggacggctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgaagtagaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacagtgcaaactagaatatcaggcatgtgtcttaggaaaacagatctcagtcaaatgtgaaggacattgcccatgtccttcagataagcccaccagtacaagcagaaatgttaagagagtactctgagtgctatggaaccctatcaagaaacaaagtttatttcattattgtgctatgattataagttaactgatttaaggaaaaagtattattgattaagaattaatgtatgccattttccaagtgacaaataatttagttttaacgtttaattttgtatgatggaatttttttatatcctctgaattatggaatggattttcaatgagaaacagattaacatcagtgtattaatatactcttgcaacatgcatgcttctccgtaactaatatagtgtattcataaatggtaagttcttctgtaattttgtttaattggagccatggaaaaataaaattaagtcagtttattggcaagtgttgcataattatttataataaaaattaagttttactcatttggattatttgaaatacattcttggattaaattaatgtgtctg

SEQ ID NO: 185186 - DNA, 1588 bp, Homo sapiens
  Payload ID: 16473
  Gene Symbol: SPOCK3
  Gene Name: sparc/osteonectin, cwcv and kazal-like domains proteoglycan (testican) 3
  ENST ID: ENST00000505187
  CDS Start-End: 46-240
gcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaac

SEQ ID NO: 185187 - DNA, 1032 bp, Homo sapiens; identical to SEQ ID NO: 185185
  Payload ID: 16473
  Gene Symbol: SPOCK3
  Gene Name: sparc/osteonectin, cwcv and kazal-like domains proteoglycan (testican) 3
  ENST ID: ENST00000502741
  CDS Start-End: 114-482

SEQ ID NO: 185188 - DNA, 563 bp, Homo sapiens
  Payload ID: 16473
  Gene Symbol: SPOCK3
  Gene Name: sparc/osteonectin, cwcv and kazal-like domains proteoglycan (testican) 3
  ENST ID: ENST00000510403
  CDS Start-End: 46-563
gcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacac

SEQ ID NO: 185189 - DNA, 556 bp, Homo sapiens
  Payload ID: 16473
  Gene Symbol: SPOCK3
  Gene Name: sparc/osteonectin, cwcv and kazal-like domains proteoglycan (testican) 3
  ENST ID: ENST00000509854
  CDS Start-End: 74-556
gtgcccgctcgggctgctgcggctggggcttgcttccttatacccacctctcctcctctgggtctgcgtgtgtatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaacta

SEQ ID NO: 185190 - DNA, 2908 bp, Homo sapiens
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENST ID: ENST00000511531
  CDS Start-End: 65-1375
tcctctggctccagccaagcgtcctatccggagccaactgtagctgggatccagcgagaggaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgaagtagaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaac

SEQ ID NO: 185191 - DNA, 2180 bp, Homo sapiens
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENST ID: ENST00000502330
  CDS Start-End: 134-1444
cgcgccgggcgcagggagctgagtggacggctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgaagtagaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcc

SEQ ID NO: 185192 - DNA, 505 bp, Homo sapiens
  Payload ID: 16473
  Gene Symbol: SPOCK3
  Gene Name: sparc/osteonectin, cwcv and kazal-like domains proteoglycan (testican) 3
  ENST ID: ENST00000506697
  CDS Start-End: 160-505
gtaaagcctgcggggaggggacacgcttgcctctgcttgtctcctcctccctctaccctcgtcgttgctaatgcatgttttccagggtcgctcctggcttcgtaccccttatttgacactgacatgcccccccaccccccgttgtgtctcctctcccagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgaagtagaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccgga

SEQ ID NO: 185193 - DNA, 565 bp, Homo sapiens
  Payload ID: 16473
  Gene Symbol: SPOCK3
  Gene Name: sparc/osteonectin, cwcv and kazal-like domains proteoglycan (testican) 3
  ENST ID: ENST00000511226
  CDS Start-End: 74-313
gtgcccgctcgggctgctgcggctggggcttgcttccttatacccacctctcctcctctgggtctgcgtgtgtatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcagggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagt

SEQ ID NO: 185194 - DNA, 1510 bp, Homo sapiens
  Payload ID: 16473
  Gene Symbol: SPOCK3
  Gene Name: sparc/osteonectin, cwcv and kazal-like domains proteoglycan (testican) 3
  ENST ID: ENST00000507370
  CDS Start-End: 44-259
atttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgctt

SEQ ID NO: 185195 - DNA, 1749 bp, Homo sapiens
  Payload ID: 16473
  Gene Symbol: SPOCK3
  Gene Name: sparc/osteonectin, cwcv and kazal-like domains proteoglycan (testican) 3
  ENST ID: ENST00000502821
  CDS Start-End: 44-235
atttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagactaagaagaaaaacgattatttgacaggacagtagtgatgatcacacaagatcacatccacatgtcttctgggctcagtcaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtg

SEQ ID NO: 185196 - DNA, 505 bp, Homo sapiens; identical to SEQ ID NO: 185192
  Payload ID: 16473
  Gene Symbol: SPOCK3
  Gene Name: sparc/osteonectin, cwcv and kazal-like domains proteoglycan (testican) 3
  ENST ID: ENST00000512042
  CDS Start-End: 160-505

SEQ ID NO: 185197 - DNA, 1768 bp, Homo sapiens
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENST ID: ENST00000511269
  CDS Start-End: 94-1395
gctaatgcatgttttccagggtcgctcctggcttcgtaccccttatttgacactgacatgcccccccaccccccgttgtgtctcctctcccagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaattt

SEQ ID NO: 185198 - DNA, 2900 bp, Homo sapiens
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENST ID: ENST00000504953
  CDS Start-End: 65-1366
tcctctggctccagccaagcgtcctatccggagccaactgtagctgggatccagcgagaggaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaacc

SEQ ID NO: 185199 - DNA, 1700 bp, Homo sapiens
  Payload ID: 16473
  Gene Symbol: SPOCK3
  Gene Name: sparc/osteonectin, cwcv and kazal-like domains proteoglycan (testican) 3
  ENST ID: ENST00000511905
  CDS Start-End: 74-313
gtgcccgctcgggctgctgcggctggggcttgcttccttatacccacctctcctcctctgggtctgcgtgtgtatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcagggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgca

SEQ ID NO: 185200 - DNA, 565 bp, Homo sapiens
  Payload ID: 16473
  Gene Symbol: SPOCK3
  Gene Name: sparc/osteonectin, cwcv and kazal-like domains proteoglycan (testican) 3
  ENST ID: ENST00000515143
  CDS Start-End: 1-252
aattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattgga

SEQ ID NO: 185201 - DNA, 1456 bp, Homo sapiens
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENST ID: ENST00000512648
  CDS Start-End: 104-1045
ctcgagacggcggcgcgtgcagcagctccagaaagcagcgagttggcagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaaggtaaaagatgagacccttacagacgcaaatagttgacctgcatgtcaaattttacttattttttaagaaaataaaacagtacactatgctcattcattttgtgtatgtttttgtaattcaagtgttgaataaaagagcaaataagaagcatgttgaacaaataactctgccagagatacaacacatgctaaataagatgaaaaatagtaattaatattttgtattaatgccactacattatagtttccattatgagccaccaagaagcacacagaaatattaagaacttagatactgaaagtaatcattaaaattaatttgctatctgctttgcccacaatgtaaaataaatggattttttatcactatacggtggagttttaatgttctattttgtgatcttattaaatgagttgaatgaa

SEQ ID NO: 185202 - DNA, 1457 bp, Homo sapiens
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENST ID: ENST00000512681
  CDS Start-End: 43-1059
tttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagactgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacct

SEQ ID NO: 185203 - DNA, 1963 bp, Homo sapiens
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENST ID: ENST00000510741
  CDS Start-End: 46-1227
gcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagaggattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcc

SEQ ID NO: 185204 - DNA, 524 bp, Homo sapiens
  Payload ID: 16473
  Gene Symbol: SPOCK3
  Gene Name: sparc/osteonectin, cwcv and kazal-like domains proteoglycan (testican) 3
  ENST ID: ENST00000515316
  CDS Start-End: 44-313
atttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctctctccttccacgatttggggatttttgtgtgatgtgaatattgccataactgccttcctttggattagtacttgccagctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattat

SEQ ID NO: 185205 - DNA, 2007 bp, Homo sapiens
  Payload ID: 16473
  Gene Symbol: SPOCK3
  Gene Name: sparc/osteonectin, cwcv and kazal-like domains proteoglycan (testican) 3
  ENST ID: ENST00000535728
  CDS Start-End: 199-1233
acacatattctccacgccatggaggccactgcttgaggatgggggaggagtagtataagcagttcaatactgtcttttttaccatcttcagtgcttcttggtgatatgaagtaaaaccaggatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagg

SEQ ID NO: 185206 - DNA, 2797 bp, Homo sapiens
  Payload ID: 16473
  Gene Symbol: SPOCK3
  Gene Name: sparc/osteonectin, cwcv and kazal-like domains proteoglycan (testican) 3
  Uniprot ID: Q9BQ16
  ENST ID: ENST00000541354
  CDS Start-End: 310-1260
gtgcccgctcgggctgctgcggctggggcttgcttccttatacccacctctcctcctctgggtctgcgtgtgtatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcagggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaatttgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagattgtgctatagattttgagatctccggagattttgctagtggcgattttcatgaatggactgatgatgaggatgatgaagacgatattatgaatgatgaagatgaaattgaagatgatgatgaagatgaaggggatgatgatgatggtggtgatgaccatgatgtatacatttgattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataagtttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaaccaaa

SEQ ID NO: 185207 - DNA, 2906 bp, Homo sapiens
  Payload ID: 16474
  Gene Symbol: SPARCL1
  Gene Name: SPARC-like 1 (hevin)
  Uniprot ID: Q14515
  ENST ID: ENST00000282470
  CDS Start-End: 472-2466
aaaaaatgcataaagagccaagtgcttatattctggccaagttatgaggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgatcttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatccaaa

SEQ ID NO: 185208 - DNA, 568 bp, Homo sapiens
  Payload ID: 16474
  Gene Symbol: SPARCL1
  Gene Name: SPARC-like 1 (hevin)
  ENST ID: ENST00000458304
  CDS Start-End: 400-568
actgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagttattcaatctcctgagcctaacagcaatgtagaaacggaactttttgcttttccaaaagatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacag

SEQ ID NO: 185209 - DNA, 2994 bp, Homo sapiens
  Payload ID: 16474
  Gene Symbol: SPARCL1
  Gene Name: SPARC-like 1 (hevin)
  Uniprot ID: Q14515
  ENST ID: ENST00000418378
  CDS Start-End: 573-2567
aaaaatgcataaagagccaagtgcttatattctggccaagttatgaggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaaggccataagatgttttattgaaagaaactttcaatatcaagtaatccaaccaaccttctaagataagccttttccttcaacacaaagaagtgcattttgccaaatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgatcttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtcc

SEQ ID NO: 185210 - DNA, 950 bp, Homo sapiens
  Payload ID: 16474
  Gene Symbol: SPARCL1
  Gene Name: SPARC-like 1 (hevin)
  ENST ID: ENST00000434434
  CDS Start-End: 527-950
ggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaaggccataagatgttttattgaaagaaactttcaatatcaagtaatccaaccaaccttctaagataagccttttccttcaacacaaagaagtgcattttgccaaatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttgg

SEQ ID NO: 185211 - DNA, 2520 bp, Homo sapiens
  Payload ID: 16474
  Gene Symbol: SPARCL1
  Gene Name: SPARC-like 1 (hevin)
  Uniprot ID: Q14515
  ENST ID: ENST00000503414
  CDS Start-End: 544-2163
aacttcaatttttctgcagtggctctgggtccagccccttacttaaagatctggaaagcatgaagactgggctttttttcctatgtctcttgggaactgcagctgcaatcccggtgaaaaggagataagaagcaaaggagcaaaccaaacctaatatgaatcctgtactttggccagaagccgtggctcacatctgtaatcccagcactttgggaggccaagacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgatcttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaaga

SEQ ID NO: 185212 - DNA, 587 bp, Homo sapiens
  Payload ID: 16474
  Gene Symbol: SPARCL1
  Gene Name: SPARC-like 1 (hevin)
  ENST ID: ENST00000512317
  CDS Start-End: 228-587
aaaaagacatcaagtcctttcatgctgtcctgggaaaggcggtttggaacaagttatcctgattctagagacgatgcaaagcactgtgctaggcaccaggagaatgcagaaagggcacatccccttccttcaaggagtttacagctttctcagaagcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattg

SEQ ID NO: 185213 - DNA, 583 bp, Homo sapiens
  Payload ID: 16474
  Gene Symbol: SPARCL1
  Gene Name: SPARC-like 1 (hevin)
  ENST ID: ENST00000509407
  CDS Start-End: 153-583
attgtctgaggcaaaaagacatcaagtcctttcatgctgtcctgggaaaggcggtttggaacaagttatcctgattctagagacaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctgg

SEQ ID NO: 185214 - DNA, 561 bp, Homo sapiens
  Payload ID: 16474
  Gene Symbol: SPARCL1
  Gene Name: SPARC-like 1 (hevin)
  ENST ID: ENST00000535835
  CDS Start-End: 179-561
taaagttattcaatctcctgagcctaacagcaatgtagaaacggaactttttgcttttccaaaaggccataagatgttttattgaaagaaactttcaatatcaagtaatccaaccaaccttctaagataagccttttccttcaacacaaagaagtgcattttgccaaatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtga

SEQ ID NO: 185215 - DNA, 583 bp, Homo sapiens
  Payload ID: 16474
  Gene Symbol: SPARCL1
  Gene Name: SPARC-like 1 (hevin)
  ENST ID: ENST00000543631
  CDS Start-End: 317-583
actagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaaggtattaaaggtcactctgcaagagaaaaaaagaaaagaaaggaaaagaaaagaaaaaaaaacatgcttttaactgcagatcaatactgttgaaacagtacaccaagagatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaag

SEQ ID NO: 185216 - DNA, 818 bp, Homo sapiens
  Payload ID: 16474
  Gene Symbol: SPARCL1
  Gene Name: SPARC-like 1 (hevin)
  ENST ID: ENST00000541496
  CDS Start-End: 763-818
agaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccgtttttaattttttcagacaaatgcaagattattatctgatcattccaaaccaactgctgaaacggtagcacctgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctgg

SEQ ID NO: 185217 - DNA, 7774 bp, Homo sapiens
  Payload ID: 16475
  Gene Symbol: SPG11
  Gene Name: spastic paraplegia 11 (autosomal recessive)
  Uniprot ID: Q96JI7
  ENST ID: ENST00000261866
  CDS Start-End: 18-7349
gtaaccgccgggccaagatggctgcagaggaaggggtcgcgagtgctgcttccgccggcggtagctggggcaccgcggccatggggcgggttctaccgatgctgttggtgccagtccccgccgaggcgatggggcagctcggctcccgggcgcagctgcgcacacagccggaggctctggggagcctgacggctgcgggcagcctccaagtgctttctttgacgcctggcagccggggcgggggtcgctgctgcctggagggccccttctggcactttctatgggaggattctcgtaacagcagcacaccaactgaaaagcccaaactgctcgctcttggtgaaaattatgaactgcttatctatgaatttaatttgaaagatggaagatgtgatgcaaccattttgtatagctgtagtagggaggcattgcaaaagctcattgacgatcaagatatcagtatttccttattgtctttgagaatcctgtcatttcacaataacacatcattactgttcatcaacaaatgtgtcatcctacatattatatttcctgaaagagatgctgcaattagagtactcaactgtttcacacttcccttgcctgcacaggcagtggacatgattattgacacgcagctctgcagaggaattctttttgttttgagtagtttaggctggatctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctattttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggatgggcaccagctgaaacaactgctgctgaaggccctgactctgatgttggatgcagcagagagttatgccaaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggcttctattgtggctgaggcctacgattttgttccagattgggctgaaattttataccagcaagtgattcttaaaggagactttaattacttggaagaatttaagcagcaaaggttattaaagtccagtatatttgaagagatttccaaaaaatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttagatgatttcataggtgtctgttttcttgtactgttagcagattctgacagatgtgatgagaagaagaatgcattggagatctttgctaaagttgaacaatcccggtactgtaccatatcagtcctttgtgggtagtaggtagcaagtaagaaacttttcaggaggaaattcctatttaaaatagattgattttagatgattgttcatccacaccattttatatagatactagtattaagatcaaaagcttcctcttcctcaggacagcttctactttagatgatccaataatgattaaagaatacctgtacctgcagattccagtttcaaagaaatttaattattatttacacagttaaggaacaggtgatacattttcatttgttagaaactgatctttctgtaataaaatagattttcaattca

SEQ ID NO: 185218 - DNA, 6935 bp, Homo sapiens
  Payload ID: 16475
  Gene Symbol: SPG11
  Gene Name: spastic paraplegia 11 (autosomal recessive)
  ENST ID: ENST00000427534
  CDS Start-End: 1-6798
atggctgcagaggaaggggtcgcgagtgctgcttccgccggcggtagctggggcaccgcggccatggggcgggttctaccgatgctgttggtgccagtccccgccgaggcgatggggcagctcggctcccgggcgcagctgcgcacacagccggaggctctggggagcctgacggctgcgggcagcctccaagtgctttctttgacgcctggcagccggggcgggggtcgctgctgcctggagggccccttctggcactttctatgggaggattctcgtaacagcagcacaccaactgaaaagcccaaactgctcgctcttggtgaaaattatgaactgcttatctatgaatttaatttgaaagatggaagatgtgatgcaaccattttgtatagctgtagtagggaggcattgcaaaagctcattgacgatcaagatatcagtatttccttattgtctttgagaatcctgtcatttcacaataacacatcattactgttcatcaacaaatgtgtcatcctacatattatatttcctgaaagagatgctgcaattagagtactcaactgtttcacacttcccttgcctgcacaggcagtggacatgattattgacacgcagctctgcagaggaattctttttgttttgagtagtttaggctggatctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctattttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttag

SEQ ID NO: 185219 - DNA, 7288 bp, Homo sapiens
  Payload ID: 16475
  Gene Symbol: SPG11
  Gene Name: spastic paraplegia 11 (autosomal recessive)
  Uniprot ID: Q96JI7
  ENST ID: ENST00000535302
  CDS Start-End: 29-7021
agtgaccggaagtaaccgccgggccaagatggctgcagaggaaggggtcgcgagtgctgcttccgccggcggtagctggggcaccgcggccatggggcgggttctaccgatgctgttggtgccagtccccgccgaggcgatggggcagctcggctcccgggcgcagctgcgcacacagccggaggctctggggagcctgacggctgcgggcagcctccaagtgctttctttgacgcctggcagccggggcgggggtcgctgctgcctggagggccccttctggcactttctatgggaggattctcgtaacagcagcacaccaactgaaaagcccaaactgctcgctcttggtgaaaattatgaactgcttatctatgaatttaatttgaaagatggaagatgtgatgcaaccattttgtatagctgtagtagggaggcattgcaaaagctcattgacgatcaagatatcagtatttccttattgtctttgagaatcctgtcatttcacaataacacatcattactgttcatcaacaaatgtgtcatcctacatattatatttcctgaaagagatgctgcaattagagtactcaactgtttcacacttcccttgcctgcacaggcagtggacatgattattgacacgcagctctgcagaggaattctttttgttttgagtagtttaggctggatctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctattttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcagacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggatgggcaccagctgaaacaactgctgctgaaggccctgactctgatgttggatgcagcagagagttatgccaaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggcttctattgtggctgaggcctacgattttgttccagattgggctgaaattttataccagcaagtgattcttaaaggagactttaattacttggaagaatttaagcagcaaaggttattaaagtccagtatatttgaagagatttccaaaaaatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttagatgatttcataggtgtctgttttcttgtactgttagcagattctgacagatgtgatgagaagaagaatgcattggagatctttgctaaagttgaacaatcccggtactgtaccatatcagtcctttgtgggtagtaggtagcaagtaagaaacttttcaggaggaaattcctatttaaaatagattgattttagatgattgttcatccacaccattttatatagatactagtattaagatcaaaagcttcctcttcctcaggacagc

SEQ ID NO: 185220 - DNA, 413 bp, Homo sapiens
  Payload ID: 16475
  Gene Symbol: SPG11
  Gene Name: spastic paraplegia 11 (autosomal recessive)
  ENST ID: ENST00000560435
  CDS Start-End: 1-132
catagttatgcttcacttcagcagaacaaatggccccttctgactgttgatgttattaaccagaatacttcctgtaacaactacatgaggaatgaaattttagataagctggccaggtattataactgttgaactaatacccaatgggaagaatacaagggaagagcaagaaaaaataatggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttg

SEQ ID NO: 185221 - DNA, 561 bp, Homo sapiens
  Payload ID: 16475
  Gene Symbol: SPG11
  Gene Name: spastic paraplegia 11 (autosomal recessive)
  ENST ID: ENST00000559822
  CDS Start-End: 1-394
ttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccaagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgt

SEQ ID NO: 185222 - DNA, 447 bp, Homo sapiens
  Payload ID: 16475
  Gene Symbol: SPG11
  Gene Name: spastic paraplegia 11 (autosomal recessive)
  ENST ID: ENST00000560858
  CDS Start-End: 1-300
cagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtaaagaggattaggctgccttcagccaaatctgtcactgaagctatgcaaacggcccagccttctgagaaggtccagatgtgaaaaagctttgcatcctttgccagattttgaaggatacatccatagccattaatcatacaattattaccagctacagc

SEQ ID NO: 185223 - DNA, 468 bp, Homo sapiens
  Payload ID: 16475
  Gene Symbol: SPG11
  Gene Name: spastic paraplegia 11 (autosomal recessive)
  ENST ID: ENST00000557866
  CDS Start-End: 1-468
ttcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaagtaagtggaataaagatttctacatttgtatttat

SEQ ID NO: 185224 - DNA, 571 bp, Homo sapiens
  Payload ID: 16475
  Gene Symbol: SPG11
  Gene Name: spastic paraplegia 11 (autosomal recessive)
  ENST ID: ENST00000558155
  CDS Start-End: 1-309
cttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccaggtgaggatcatgagaagcctgaagattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaa

SEQ ID NO: 185225 - DNA, 2127 bp, Homo sapiens
  Payload ID: 16475
  Gene Symbol: SPG11
  Gene Name: spastic paraplegia 11 (autosomal recessive)
  ENST ID: ENST00000559511
  CDS Start-End: 1-1703
ttgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcaccacagagctcctgatcctggcccatcattgcttcaccctgacgtgccacatggagggcatcatccgagtcctacaggccgcccacatgctcacagataaccacctggcccccagtgaggagtatgggctggtggtacggctcctcactggcattggaaggtacaacgagatgacatacatatttgatttgctgcataaaaagcactactttgaagtgctaatgaggaagaagttggatccgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggatgggcaccagctgaaacaactgctgctgaaggccctgactctgatgttggatgcagcagagagttatgccaaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggcttctattgtggctgaggcctacgattttgttccagattgggctgaaattttataccagcaagtgattcttaaaggagactttaattacttggaagaatttaagcagcaaaggttattaaagtccagtatatttgaagagatttccaaaaaatataaacaacatcagcctactgacatggtcatggaaaacctgaagaaattactcacatattgtgaagatgtttacctgtattacaagttggcatacgaacacaagttttatgaaattgtaaatgtgcttctgaaggaccctcagacaggttgctgtctaaaggacatgctagcaggttagatgatttcataggtgtctgttttcttgtactgttagcagattctgacagatgtgatgagaagaagaatgcattggagatctttgctaaagttgaacaatcccggtactgtaccatatcagtcctttgtgggtagtaggtagcaagtaagaaacttttcaggaggaaattcctatttaaaatagattgattttagatgattgttcatccacaccattttatatagatactagtattaagatcaaaagcttcctcttcctcaggacagcttctactttagatgatccaataatgattaaagaatacctgtacctgcagattccagtttcaaagaaatttaattattatttacacagttaaggaacaggtgatacattttcatttgttagaaactgatctttctgtaataaaatagattttcaattc

SEQ ID NO: 185226 - DNA, 750 bp, Homo sapiens
  Payload ID: 16475
  Gene Symbol: SPG11
  Gene Name: spastic paraplegia 11 (autosomal recessive)
  ENST ID: ENST00000558138
  CDS Start-End: 1-750
acaggacataagcagatgttcaacccaacagaggaaagccagacatttcttcagctgaccactctgtgtcaagaccgcacattggtaggcatgaagttgttggataagatttcctccgttccccatggggaactgtcttgcaccacagagctcctgatcctggcccatcattgcttcaccctgacgtgccacatggagggcatcatccgagtcctacaggccgcccacatgctcacagataaccacctggcccccagtgaggagtatgggctggtgagtggtaccctgaaaacagccctgctggactacatcaaacgctgccgtcctggagacagtgaaaagcacaatatgattgccctgtgcttcagcatgtgccgggagattggcgagaaccacgaggcagctgcccgcatccaactgaaattgattgagtctcagccctgggaggacagcctcaaggatgggcaccagctgaaacaactgctgctgaaggccctgactctgatgttggatgcagcagagagttatgccaaggactcctgtgtgcgacaggcccagcactgtcagcggctcaccaagttgataactctgcagattcactttctgaacactggccagaacacaatgctcatcaacttgggccgccacaagctgatggactgtattctggccctacctcggttctaccaggcttctattgtggctgaggcctacgattttgttccagattgggctgaaattttataccag

SEQ ID NO: 185227 - DNA, 411 bp, Homo sapiens
  Payload ID: 16475
  Gene Symbol: SPG11
  Gene Name: spastic paraplegia 11 (autosomal recessive)
  ENST ID: ENST00000559754
  CDS Start-End: 1-323
ctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggaggaatcaggtcacaatgtgaaaagtccttggaattccatgagaaaacacaactttatttcagaaataagctttgaactttgaaaacaagagcagatgcatggagtcatctcccacatttctctagccctgacctggttaataaatatgctatagtggaacgtc

SEQ ID NO: 185228 - DNA, 6426 bp, Homo sapiens
  Payload ID: 16475
  Gene Symbol: SPG11
  Gene Name: spastic paraplegia 11 (autosomal recessive)
  Uniprot ID: Q96JI7
  ENST ID: ENST00000558319
  CDS Start-End: 32-6271
gaaagtgaccggaagtaaccgccgggccaagatggctgcagaggaaggggtcgcgagtgctgcttccgccggcggtagctggggcaccgcggccatggggcgggttctaccgatgctgttggtgccagtccccgccgaggcgatggggcagctcggctcccgggcgcagctgcgcacacagccggaggctctggggagcctgacggctgcgggcagcctccaagtgctttctttgacgcctggcagccggggcgggggtcgctgctgcctggagggccccttctggcactttctatgggaggattctcgtaacagcagcacaccaactgaaaagcccaaactgctcgctcttggtgaaaattatgaactgcttatctatgaatttaatttgaaagatggaagatgtgatgcaaccattttgtatagctgtagtagggaggcattgcaaaagctcattgacgatcaagatatcagtatttccttattgtctttgagaatcctgtcatttcacaataacacatcattactgttcatcaacaaatgtgtcatcctacatattatatttcctgaaagagatgctgcaattagagtactcaactgtttcacacttcccttgcctgcacaggcagtggacatgattattgacacgcagctctgcagaggaattctttttgttttgagtagtttaggctggatctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggttgaaattttaaaagaaaaaaattatttttctgaaaaagagaaaagaactatagacttcgtgcatcaagttgagaagctttatttgggacatttccaagaaaatatgcaaatccagtcatttcccaggtactggataaaggaacaagattttttcaagcacaagtctgttttggactcattcctgaaatatgattgtaaagatgaatttaacaaacaggaccatagaattgtgttaaattgggctctgtggtgggatcaactaacacaagaatccatccttctccccaggataagtccagaagaatacaaatcatattcccctgaagccctctggagatacctcacagctcgccatgattggttaaacattatcttatggattggagaatttcaaacccagcatagttatgcttcacttcagcagaacaaatggccccttctgactgttgatgttattaaccagaatacttcctgtaacaactacatgaggaatgaaattttagataagctggccaggaatggggtttttttggcatctgaactggaagactttgaatgcttcctcctaagactgagccgtattggaggtgtaatacaggataccctccctgttcaaaactacaagaccaaagaaggttgggatttccattctcaattcattctctattgtttggagcacagtctgcagcatcttctttatgtctaccttgactgttacaaacttagtcctgaaaattgtccctttttggaaaaaaaagagttacatgaagcacacccttggtttgaatttttagttcagtgtcgacaagttgccagtaacttaacagatcccaaactgatcttccaggctagccttgcaaatgctcagattttgattcccaccaatcaggccagtgtaagcagtatgctattggaaggacataccctcctggcccttgctactacaatgtattctcctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgatccagcaagtaggcaatgaagcctatgttatagggctctcctccttccacataccttcaataggagctgcatgtgtttgtttcttagaattgcttggccttgacagcctcaagctcagagttgatatgaaagtggccaatataattttgagctacaagtgcagaaatgaagatgctcagtacagctttatcagagagtctgtagccgaaaaactatctaaactagctgatggtgaaaagacaaccacagaagaattgcttgttctcttagaagaaggtacatggaacagcattcagcaacaggaaataaagaggttatccagtgaatctagcagccaatgggcattagtggtgcagttctgcaggctacacaatatgaaactaagcatatcttaccttagagaatgtgccaaagcaaatgattggctgcagttcattattcacagccaactccacaactaccacccagcagaggtgaaatcccttatccagtacttcagcccagtcattcaagaccacttaaggctggcttttgagaacttgccctcagtgcccacctccaaaatggacagcgatcaagtctgcaataagtgcccccaggaacttcaaggaagcaaacaagagatgaccgatttatttgaaattctgctccaatgctcagaggagccagactcctggcactggcttctggttgaagcagtgaaacaacaggcccctatcctcagtgttctggcctcatgtctccagggtgccagtgccatttcttgtctctgtgtttggatcatcacttctgtggaggacaatgttgcaactgaagcaatgggacacattcaggactcaacagaggaccatacctggaaccttgaggatctttcagtcatctggagaacattattaacaagacaaaagagcaaaactctcatcagaggtttccagcttttctttaaggattccccgttactactggtgatggagatgtatgaactgtgtatgttcttcaggaattataaagaagctgaagctaaacttctggagtttcagaagagccttgaaacgcttaacacagcagccacaaaggtccaccctgtcatccctgccatgtggctggaggatcaggtgtgtttccttttgaagcttatgctacagcagtgtaagacccagtatgagctggggaagcttttacagctctttgttgaaagagagcatctcttctctgatggtccagatgtgaaaaagctttgcatcctttgccagattttgaaggatacatccatagccattaatcatacaattattaccagctacagcattgagaatcttcagcatgaatgtagatctattttggaaagactgcagacagatggacaattcgctttggccaggagggtagcagaattagctgagttacctgtggacaacttggttattaaagagataacacaggaaatgcagaccctaaaacacattgaacagtggtcactaaaacaagcaagaattgacttctggaaaaaatgccatgagaattttaagaaaaattcaatttcaagcaaagcagcttcttcctttttctcaacccaggcccatgtggcatgtgagcacccaactggatggagcagcatggaggagcgccatctgctgctcaccttggcagggcactggcttgcccaggaggacgtggtgcccttggataagctggaggagctggagaagcagatctggctgtgccgcatcacccagcacactcttggaagaaatcaggaggaaacagagcccagattttctcgacagatctcaactagtggtgaactttcctttgatagtttagccagtgagttttccttctccaagttggctgctctgaacacatcaaaatacttagaacttaacagccttccatccaaagagacatgcgagaatagattggattggaaagagcaggagtcactaaactttttgattgggcgcctactggatgatggctgtgtgcatgaagcaagtagagtatgccggtattttcatttttataatccagatgtcgccttggtattgcactgcagagcactggcctcaggggaagctagtatggaggatctgcacccagagatccatgctctcctacaaagtgctgagctgcttgaggaagaagcacccgacattcccctaaggagagtccacagcacttcaagtctggatagtcagaagtttgtgacagtgccctccagtaatgaagtggtaactaacctggaagtgctgacaagcaaatgcctccatgggaagaactactgtcgacaggtcctctgtctgtatgatcttgccaaggagttgggctgttcctacacagatgttgctgctcaggatggtgaagccatgctccggaaaatcttggcctctcagcagcctgaccgatgcaaacgagcccaggccttcatcagcacacagggccttaagccagatactgtggctgaactcgtggcagaagaggtgacacgggagctgcttacttcatcacagggaacaggtgccctaccccccggggattcccaacctctctgacagcattctctagttcccagtgttaaggatttggatgttgtgcttatatacatcctgtatgtggttctctcaagtttctggattgcagtaatgtattttgtttaaataaaacaaaatacatgctttattttttacaaaatacatgtacaaaatac

SEQ ID NO: 185229 - DNA, 2579 bp, Homo sapiens
  Payload ID: 16475
  Gene Symbol: SPG11
  Gene Name: spastic paraplegia 11 (autosomal recessive)
  ENST ID: ENST00000559193
  CDS Start-End: 12-2351
gccgggccaagatggctgcagaggaaggggtcgcgagtgctgcttccgccggcggtagctggggcaccgcggccatggggcgggttctaccgatgctgttggtgccagtccccgccgaggcgatggggcagctcggctcccgggcgcagctgcgcacacagccggaggctctggggagcctgacggctgcgggcagcctccaagtgctttctttgacgcctggcagccggggcgggggtcgctgctgcctggagggccccttctggcactttctatgggaggattctcgtaacagcagcacaccaactgaaaagcccaaactgctcgctcttggtgaaaattatgaactgcttatctatgaatttaatttgaaagatggaagatgtgatgcaaccattttgtatagctgtagtagggaggcattgcaaaagctcattgacgatcaagatatcagtatttccttattgtctttgagaatcctgtcatttcacaataacacatcattactgttcatcaacaaatgtgtcatcctacatattatatttcctgaaagagatgctgcaattagagtactcaactgtttcacacttcccttgcctgcacaggcagtggacatgattattgacacgcagctctgcagaggaattctttttgttttgagtagtttaggctggatctacatttttgatgttgtggatggtacatatgtagctcatgtggatttagcacttcacaaagaagacatgtgtaatgagcagcaacaggagccagccaagatttcttcatttacttcactgaaagtttctcaagacctcgatgttgcagtgattgtcagctcctccaactccgcagttgctcttaacttaaatttgtatttcaggcaacacccaggacacctactgtgtgaaagaatactagaagatcttcctattcaaggacctaagggcgtagatgaagatgatcctgttaactctgcctacaacatgaaactggccaagttttccttccaaattgataggtcttggaaagcccagctatcatcattgaatgaaacaataaagaactccaaactggaggtttcctgttgtgctccatggttccaggatattttgcatttggagtcacctgaatctggtaaccacagtacaagtgtgcagagctgggccttcattccacaggacataatgcatgggcaatataatgttctacagaaagatcatgccaagaccagtgatccaggaagatcatggaaaataatgcacatcagtgaacaagaggaacccatagagcttaaatgtgtgtctgtgacaggattcactgcactgtttacttgggaagtggaaaggatgggctataccattaccctctgggatttggagacccagggcatgcagtgtttttcccttggcacaaagtgtattcctgtagacagtagtggagaccagcagctgtgctttgttttgacagagaatggactctctctgattttgtttggtttgactcaagaagagtttttaaacagactcatgatccatggaagtgccagcactgtggacactctttgtcatctcaatggctggggaaggtgctcaattcccatacatgcactagaggccgggatagaaaatcgtcagctggacacagtaaatttctttttgaagagcaaggaaaatctttttaatccatcctcaaaatcttctgtatctgatcagtttgatcacttgtcatcccatttatatttaagaaatgtggaagagctgataccagcattggatttactttgctcggcaattagagaaagttattctgaaccccaaagcaaacacttttcagaacaattgcttaatcttacactgtctttccttaacaaccaaataaaggagcttttcattcacactgaagaactagatgaacatctgcaaaaaggagtgaacattttgactagctacattaatgaacttcgaaccttcatgataaagtttccttggaagctaacagatgctatagatgaatatgatgtacatgaaaatgtccccaaagtaaaggagagcaatatatggaagaaactcagctttgaggaagttattgccagcgccattttaaacaacaaaataccagaggcacagactttcttcaggattgatagtcattctgctcaaaaacttgaggagcttattggcataggcctaaatttggtctttgacaatttaaaaaagaacaatataaaggaagcctctgaacttttgaagaatatggggtttgatgtaaaaggccaattgctcaagatctgcttctatacaactaataaaaatatacgtgactttttggtaggtaaaggtgagactacatagtatacattttctagaaagcctgggtgaaaaacttggaagaaaaccttggaagaaaaaccttaagtaattttaatgttcaactaatatctaataagtaaaagtgtgacaaccccttcatctttttttccccttcatctttcttcaatgactattttacatttgtggcaaaagaaaatttgtgttaacatacattaactcaaatgttcaaaatataattcttgaatggca

SEQ ID NO: 185230 - DNA, 620 bp, Homo sapiens
  Payload ID: 16475
  Gene Symbol: SPG11
  Gene Name: spastic paraplegia 11 (autosomal recessive)
  ENST ID: ENST00000558988
  CDS Start-End: 1-417
cctgggggtgtcagtcaggttgttcagaatgaagaaaatgaaaactgtttgaagaaagtggatccccagctattgaagatggcattaactccttaccccaagctaaaaactgctctcttcccacagtgcactcctcctagtgtcctgccatctgatattacaatctaccaccttattcagtcattatcaccctttgatcctagcagattgtttggctggcagtctgctaacacactagctataggagatgcatggagtcatctcccacatttctctagccctgacctggttaataaatatgctatagtggaacgtctgaattttgcttattatttacataatgggcggccatcatttgcatttggtacttttctggtccaggaattaatcaagagcaagactcccaagcagctgtgagtatttaaaatataattttgtctgggtacagtggttcacacctgtaatcccagcactttgggaagcaggaggatcacttgagcccaggagttcaaggaagcagtgagctatggtcatgccactgcactctagcctgggtgacagtgaggctctgccactaaaacaaaaaaagtaaaataaaatataatttgtattctaaaaaa

SEQ ID NO: 185231 - DNA, 4820 bp, Homo sapiens
  Payload ID: 16476
  Gene Symbol: SPG20
  Gene Name: spastic paraplegia 20 (Troyer syndrome)
  Uniprot ID: Q8N0X7
  ENST ID: ENST00000355182
  CDS Start-End: 95-2095
accagtaccagcccccaccttccgtctgtgcatgttttcttcagtcctggaaggaaatcataagtgatttgccccaaaaggattgctgttgaaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacagagcagaagaagaaaatgaattccaaatccctggaagaactagaccctcctctgaccaactaaaagaagcctctggcactgatgtgaaacagttggaccaaggcaataaggatgtacgtcataaaggaaaacgtggaaaaagggctaaagatacttcaagtgaagaagttaacctgagtcacattgtaccatgtgagccagttccagaagaaaagccaaaagaattacctgaatggagtgaaaaagtggctcacaacattttgtcaggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctggttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaataaataaaaatagattattacgtcttttgtattgagactgtattgttatgagcctaggaaatttgggaacatgattgtattgtattaaaattcgaagtgattattatcagcttaattggattaaaaaagtacttcaagaaattattttatcatatctgcttctgtttttccaaaaggttaaaacttgtaaaaaaaatatatataaacaattgagtttactaatggtaaacatttttattctgggattcggtcattggaatttatattaaaagacaagttattaaaaaggaaaggttctattcataatcagggtaaagaatatgaaaaccttagacgtaatccatggtggataggcattatggtttccactttggcagaaggcagactattcacagccctatttacttacataggctaaaaaactatgtaactaaatacctaatggtatttaatttttgtttattgaatttaagagattggtattagttttcatagctgtagtccattctaataatttctgatcttctagtggctacttaattagacattatttgaagctgtctgaagaatgcactttatgaattaaaaaactgaattgcctgacctcgttatcacatgagcttatattttgggaacacatagaactgatggaggcttttcctaaggccaaggataatgtactagttgttaaaatggaaataaaagtgaagtggtaaatagcttacagacagtctatgctttgtttaagaaatggaatggcacttcatatattctcatttgtgggagctaaaaattacaataatcaaacttaaggagatagagagtagaatgatggttaccagaggctgggaggcattgaagggatggggagggaagtgaggttgattaatgggtacgaaaatatagttagaacgaatttgttgtagtatttgatagcccaacagggtgactacagtcaacaataactttatacatttaaaaataaaagagtgtaattgggacgtttgtaacacaaatgaatgcttgaagcagtagatacaccctgatgtaattattataaatcgcatacctgtatcaaaatatctcatgtatcccataaatatatacacctaccatgtacccataaaaatttaaaaagaaatggaatggcaaataatggaacataaactttaaacagttagctttgaccagaggtcagcaaatatcctccatgggctaaatccagatgtccacctgttttcataaataacgttttattggagcatagctgtacccatttgtttacatattggctatggctgctgtctagttcaacgtgagagttgaatagttgcatcagagagtatatggtccacaagcctaacttattcactctctggccctttgcagaaaaagtgtgctgccttagtctatagaaaatggacttttcccaccattcactgactcattaggagataggcatcttctaaagattttttttatattgtgtaatgattgatatatagataaaattatatattacttgtaaggtatgatgaataacaacacttaaaaactcatcacacctaaagacatggaaagctgccaattacctatatgtatgttcttcctattttcttacctctttccccatgtcattttttattgttccttgccattttttaatcacacatgtatgttctccaaacatactgtttcattttttgaagctttctacatatagtgtctgaatgtgaagtcttactcaacttgcttttttgagtttatgtttaaaattcattcttgcgcttatatgcatggatggtttacttgctctatagtattctgtgtgagtataccacaatttaagtgttcattttcctatcagttgacatttgtttttagtttttgttggtagaaacagtacactcaaaacatccttgactgtcccctggtacacatatgcaagagactttatgcgtaagagtggagttgttggcttgtcaagttttgcaaaataatgccaggtattttccaaaatgatgatattctcttgagtattacttccctttgcaatgtttttattgttaatgtagcatatataaaaaagtatctcataatttt

SEQ ID NO: 185232 - DNA, 4789 bp, Homo sapiens
  Payload ID: 16476
  Gene Symbol: SPG20
  Gene Name: spastic paraplegia 20 (Troyer syndrome)
  Uniprot ID: Q8N0X7
  ENST ID: ENST00000438666
  CDS Start-End: 62-2062
gcggccgcgcagggagctctcgaggcaacgccggggcgcccgaggtctggaaggcgcagaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacagagcagaagaagaaaatgaattccaaatccctggaagaactagaccctcctctgaccaactaaaagaagcctctggcactgatgtgaaacagttggaccaaggcaataaggatgtacgtcataaaggaaaacgtggaaaaagggctaaagatacttcaagtgaagaagttaacctgagtcacattgtaccatgtgagccagttccagaagaaaagccaaaagaattacctgaatggagtgaaaaagtggctcacaacattttgtcaggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctggttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaataaataaaaatagattattacgtcttttgtattgagactgtattgttatgagcctaggaaatttgggaacatgattgtattgtattaaaattcgaagtgattattatcagcttaattggattaaaaaagtacttcaagaaattattttatcatatctgcttctgtttttccaaaaggttaaaacttgtaaaaaaaatatatataaacaattgagtttactaatggtaaacatttttattctgggattcggtcattggaatttatattaaaagacaagttattaaaaaggaaaggttctattcataatcagggtaaagaatatgaaaaccttagacgtaatccatggtggataggcattatggtttccactttggcagaaggcagactattcacagccctatttacttacataggctaaaaaactatgtaactaaatacctaatggtatttaatttttgtttattgaatttaagagattggtattagttttcatagctgtagtccattctaataatttctgatcttctagtggctacttaattagacattatttgaagctgtctgaagaatgcactttatgaattaaaaaactgaattgcctgacctcgttatcacatgagcttatattttgggaacacatagaactgatggaggcttttcctaaggccaaggataatgtactagttgttaaaatggaaataaaagtgaagtggtaaatagcttacagacagtctatgctttgtttaagaaatggaatggcacttcatatattctcatttgtgggagctaaaaattacaataatcaaacttaaggagatagagagtagaatgatggttaccagaggctgggaggcattgaagggatggggagggaagtgaggttgattaatgggtacgaaaatatagttagaacgaatttgttgtagtatttgatagcccaacagggtgactacagtcaacaataactttatacatttaaaaataaaagagtgtaattgggacgtttgtaacacaaatgaatgcttgaagcagtagatacaccctgatgtaattattataaatcgcatacctgtatcaaaatatctcatgtatcccataaatatatacacctaccatgtacccataaaaatttaaaaagaaatggaatggcaaataatggaacataaactttaaacagttagctttgaccagaggtcagcaaatatcctccatgggctaaatccagatgtccacctgttttcataaataacgttttattggagcatagctgtacccatttgtttacatattggctatggctgctgtctagttcaacgtgagagttgaatagttgcatcagagagtatatggtccacaagcctaacttattcactctctggccctttgcagaaaaagtgtgctgccttagtctatagaaaatggacttttcccaccattcactgactcattaggagataggcatcttctaaagattttttttatattgtgtaatgattgatatatagataaaattatatattacttgtaaggtatgatgaataacaacacttaaaaactcatcacacctaaagacatggaaagctgccaattacctatatgtatgttcttcctattttcttacctctttccccatgtcattttttattgttccttgccattttttaatcacacatgtatgttctccaaacatactgtttcattttttgaagctttctacatatagtgtctgaatgtgaagtcttactcaacttgcttttttgagtttatgtttaaaattcattcttgcgcttatatgcatggatggtttacttgctctatagtattctgtgtgagtataccacaatttaagtgttcattttcctatcagttgacatttgtttttagtttttgttggtagaaacagtacactcaaaacatccttgactgtcccctggtacacatatgcaagagactttatgcgtaagagtggagttgttggcttgtcaagttttgcaaaataatgccaggtattttccaaaatgatgatattctcttgagtattacttccctttgcaatgtttttattgttaatgtagcatatataaaaaagtatctcataattttaa

SEQ ID NO: 185233 - DNA, 4944 bp, Homo sapiens
  Payload ID: 16476
  Gene Symbol: SPG20
  Gene Name: spastic paraplegia 20 (Troyer syndrome)
  Uniprot ID: Q8N0X7
  ENST ID: ENST00000451493
  CDS Start-End: 219-2219
cggaggcctcggtttcgctggagagaaagagattgcgcaggcgccgagcagccgacgtggccgcaggggaccgtgcctgggggggtctgcgcggggccgctgactcgcgaggttctctgtcgcctgccgccctcgctccttttctccccttctagagtgttacggtgactcttgggtccgaaggggacggacgtcctcccacgtaccatttagaagaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacagagcagaagaagaaaatgaattccaaatccctggaagaactagaccctcctctgaccaactaaaagaagcctctggcactgatgtgaaacagttggaccaaggcaataaggatgtacgtcataaaggaaaacgtggaaaaagggctaaagatacttcaagtgaagaagttaacctgagtcacattgtaccatgtgagccagttccagaagaaaagccaaaagaattacctgaatggagtgaaaaagtggctcacaacattttgtcaggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctggttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaataaataaaaatagattattacgtcttttgtattgagactgtattgttatgagcctaggaaatttgggaacatgattgtattgtattaaaattcgaagtgattattatcagcttaattggattaaaaaagtacttcaagaaattattttatcatatctgcttctgtttttccaaaaggttaaaacttgtaaaaaaaatatatataaacaattgagtttactaatggtaaacatttttattctgggattcggtcattggaatttatattaaaagacaagttattaaaaaggaaaggttctattcataatcagggtaaagaatatgaaaaccttagacgtaatccatggtggataggcattatggtttccactttggcagaaggcagactattcacagccctatttacttacataggctaaaaaactatgtaactaaatacctaatggtatttaatttttgtttattgaatttaagagattggtattagttttcatagctgtagtccattctaataatttctgatcttctagtggctacttaattagacattatttgaagctgtctgaagaatgcactttatgaattaaaaaactgaattgcctgacctcgttatcacatgagcttatattttgggaacacatagaactgatggaggcttttcctaaggccaaggataatgtactagttgttaaaatggaaataaaagtgaagtggtaaatagcttacagacagtctatgctttgtttaagaaatggaatggcacttcatatattctcatttgtgggagctaaaaattacaataatcaaacttaaggagatagagagtagaatgatggttaccagaggctgggaggcattgaagggatggggagggaagtgaggttgattaatgggtacgaaaatatagttagaacgaatttgttgtagtatttgatagcccaacagggtgactacagtcaacaataactttatacatttaaaaataaaagagtgtaattgggacgtttgtaacacaaatgaatgcttgaagcagtagatacaccctgatgtaattattataaatcgcatacctgtatcaaaatatctcatgtatcccataaatatatacacctaccatgtacccataaaaatttaaaaagaaatggaatggcaaataatggaacataaactttaaacagttagctttgaccagaggtcagcaaatatcctccatgggctaaatccagatgtccacctgttttcataaataacgttttattggagcatagctgtacccatttgtttacatattggctatggctgctgtctagttcaacgtgagagttgaatagttgcatcagagagtatatggtccacaagcctaacttattcactctctggccctttgcagaaaaagtgtgctgccttagtctatagaaaatggacttttcccaccattcactgactcattaggagataggcatcttctaaagattttttttatattgtgtaatgattgatatatagataaaattatatattacttgtaaggtatgatgaataacaacacttaaaaactcatcacacctaaagacatggaaagctgccaattacctatatgtatgttcttcctattttcttacctctttccccatgtcattttttattgttccttgccattttttaatcacacatgtatgttctccaaacatactgtttcattttttgaagctttctacatatagtgtctgaatgtgaagtcttactcaacttgcttttttgagtttatgtttaaaattcattcttgcgcttatatgcatggatggtttacttgctctatagtattctgtgtgagtataccacaatttaagtgttcattttcctatcagttgacatttgtttttagtttttgttggtagaaacagtacactcaaaacatccttgactgtcccctggtacacatatgcaagagactttatgcgtaagagtggagttgttggcttgtcaagttttgcaaaataatgccaggtattttccaaaatgatgatattctcttgagtattacttccctttgcaatgtttttattgttaatgtagcatatataaaaaagtatctcataatttt

SEQ ID NO: 185234 - DNA, 3018 bp, Homo sapiens
  Payload ID: 16476
  Gene Symbol: SPG20
  Gene Name: spastic paraplegia 20 (Troyer syndrome)
  Uniprot ID: Q8N0X7
  ENST ID: ENST00000494062
  CDS Start-End: 255-2255
ggcggcggcgtgctgcgggctctgtggcgggagcgaggccgacgggcggggccgcgcggccgcgtgacgcgaagcgttcgagagcgcgcgtcgtggaacgtcttggttgccacggcaagcgcgcgcgcgaggccttgggaacctcgggaccggcccccggcgagcgcagcggcgcccagtagtcatcttagtgggatttggggaagcaacagggctgtgtggggtaacctgccacctttaagtggaaatcagaaatggagcaagagccacaaaatggagaacctgctgaaattaagatcatcagagaagcatataagaaggcctttttatttgttaacaaaggtctgaatacagatgaattaggtcagaaggaagaagcaaagaactactataagcaaggaataggacacctgctcagagggatcagcatttcatcaaaagagtctgaacacacaggtcctgggtgggaatctgctagacagatgcaacagaaaatgaaagaaactctacagaatgtacgcaccaggctggaaattctagagaagggtcttgccacttctctgcagaatgatcttcaggaggtgcccaagttatatccagaatttccacctaaagacatgtgtgaaaaattaccagagcctcagtcttttagttcagctcctcagcatgctgaagtaaatggaaacacctcaactccaagtgcaggggcagttgctgcacctgcttctctgtctttaccatcacaaagttgtccagcagaagctcctcctgcttatactcctcaagctgctgaaggtcactacactgtatcctatggaacagattctggggagttttcatcagttggagaggagttttataggaatcattctcagccaccgcctcttgagaccttagggctggatgcagatgaattgattttgataccaaatggagtacagattttttttgtaaatcctgcaggggaggttagtgcaccttcgtatcctgggtaccttcgaattgtgaggtttttggataattctctcgatacggttctaaaccgtcctcccgggtttcttcaggtttgtgactggttatatcctctagttcctgatagatctccggttctgaaatgtactgcgggagcctacatgtttcctgatacaatgctacaagcagcaggatgctttgtgggggtcgtcctgtcctctgagttaccagaggatgatagagagctctttgaggatctgttaaggcaaatgtctgaccttcggctccaggccaactggaacagagcagaagaagaaaatgaattccaaatccctggaagaactagaccctcctctgaccaactaaaagaagcctctggcactgatgtgaaacagttggaccaaggcaataaggatgtacgtcataaaggaaaacgtggaaaaagggctaaagatacttcaagtgaagaagttaacctgagtcacattgtaccatgtgagccagttccagaagaaaagccaaaagaattacctgaatggagtgaaaaagtggctcacaacattttgtcaggtgcttcctgggtgagttggggtttagtcaaaggtgctgagattactggtaaggcaatccagaaaggtgcttctaaactccgagagcggattcaaccagaagaaaaacccgtggaagttagtccagctgtcaccaagggactttatatagcgaagcaagctacaggaggagcagcaaaagtcagtcagttcctggttgatggagtttgcactgtagcaaattgcgttggaaaagaactagctccacatgtcaagaagcatggaagcaaacttgttccagaatctcttaaaaaagacaaagatgggaaatctcctctggatggtgctatggttgtagcagcaagtagtgttcaaggattttcaactgtctggcaaggattggaatgtgcagctaaatgcatcgttaacaatgtttcagcagaaactgtacaaactgtcagatacaaatacggatataatgcaggagaagctacccaccatgcggtggattctgcggtcaatgttggcgtaactgcctacaatattaacaacattggtatcaaagcaatggtgaagaaaactgcaacacaaacaggacacactctccttgaggactatcagatagttgataattctcagagggaaaatcaagaaggagcagcaaatgtcaacgtgagaggggagaaggatgagcagacgaaggaagtaaaggaggcaaagaagaaagataaatgatgaagtgctgggaatcacttataccaaagccttatgaaatggatgaaattttgttaaataggcaaatgtggaattcctcacagattaaccagtattttttaaatgtattcattcctacaaattaactttcataaattttatggcatgtcttctatttaaaaggaaaagaataagtattcttgcatctggccttagaaatgtgaagttatattctcaagtttatttttttccaagtgtagctaaaatatttttgcaggtaaaataaagctgatagtacatgtgttgttcaaaccttgttaaacctaatattgaactatttttatatctgctgtctttcagaaggcaaataggaaactatatatttgcttaaaaattggcatttagtaaccttaattctttttatagaaggaatgacttaaagtattgtcccctctttttgcactaattgtggatttttttagatgcttctcaaaattttcagtgtgtaagctaaacaaaaactaaaactaagaattctcaaaaaaacttgttcaaaacagggaaagactgatgaaaagtaaaatggactacttttgtaacttacctgtttgttaggaaatggaatggtctctttgatttaaaataaataaaaatagattattacgtcttttgtattgagactgtattgttatgagcctaggaaatttgggaacatgattgtattgtattaaaattcgaagtgattattatcagcttaattggattaaaaaagtacttcaagaaa

SEQ ID NO: 185235 - DNA, 1822 bp, Homo sapiens
  Payload ID: 16477
  Gene Symbol: SPG21
  Gene Name: spastic paraplegia 21 (autosomal recessive, Mast syndrome)
  Uniprot ID: Q9NZD8
  ENST ID: ENST00000204566
  CDS Start-End: 297-1223
cgccctctgagaacccggaagcgggagtctcgcgccagctgagcggcggtcgggcggggggagcgcggcggcccaagctcgctcggccacgcgccccgccccctcagaggccggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatggtagacaggctagaaagtttgggtcagagtgaactggcttcaagacttaccttgaattgtcaaaattcttatgtggaacctcataaaattcgggacatacctgtaactattatggatgtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccagccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcaaattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaatttaactgag

SEQ ID NO: 185236 - DNA, 1533 bp, Homo sapiens
  Payload ID: 16477
  Gene Symbol: SPG21
  Gene Name: spastic paraplegia 21 (autosomal recessive, Mast syndrome)
  Uniprot ID: Q9NZD8
  ENST ID: ENST00000416889
  CDS Start-End: 272-1117
agtctcgcgccagctgagcggcggtcgggcggggggagcgcggcggcccaagctcgctcggccacgcgccccgccccctcagaggccggcctcccgcacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctgttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatggtagacaggctagaaagtttgggtcagagtgaactggcttcaagacttaccttgaattgtcaaaattcttatgtggaacctcataaaattcgggacatacctgtaactattatggatgtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccagccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcaaattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatca

SEQ ID NO: 185237 - DNA, 1613 bp, Homo sapiens
  Payload ID: 16477
  Gene Symbol: SPG21
  Gene Name: spastic paraplegia 21 (autosomal recessive, Mast syndrome)
  Uniprot ID: Q9NZD8
  ENST ID: ENST00000433215
  CDS Start-End: 94-1020
gggtggtcggtgtgcttgtgaccctgcctttgtgtggctgtcaccggtgggactggcggggagctgtgtgattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatggtagacaggctagaaagtttgggtcagagtgaactggcttcaagacttaccttgaattgtcaaaattcttatgtggaacctcataaaattcgggacatacctgtaactattatggatgtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccagccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcaaattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaattta

SEQ ID NO: 185238 - DNA, 624 bp, Homo sapiens
  Payload ID: 16477
  Gene Symbol: SPG21
  Gene Name: spastic paraplegia 21 (autosomal recessive, Mast syndrome)
  ENST ID: ENST00000558765
  CDS Start-End: 173-624
gcctcctgaaggaggggaagggacgtgggggcggccacggcagcaaacttttaagaactgtgagcagaggccagtaattttggagacaggacctcggcctgaaagtgatagatgtctttgttgttactgagtgtgggccaggtgtaaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacag

SEQ ID NO: 185239 - DNA, 1520 bp, Homo sapiens
  Payload ID: 16477
  Gene Symbol: SPG21
  Gene Name: spastic paraplegia 21 (autosomal recessive, Mast syndrome)
  ENST ID: ENST00000561078
  CDS Start-End: 176-565
cacgcaccgcgcagcctgctgtgcccgtgggtcccgagtgctccgccgcccgccccgacccgggcccagccgcctccacggcccgcgctcgtactggagcgaagagcggcctcctgaaggaggggaagggacgtgggggcggccacggcaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaacttttggctgatgcctgcatttatgctcaaaaaaatagttcttggaaatttttcatctggcccggtggaccctatgatggctgatgccattgatttcatggtagacaggctagaaagtttgggtcagagtgaactggcttcaagacttaccttgaattgtcaaaattcttatgtggaacctcataaaattcgggacatacctgtaactattatggatgtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccagccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcaaattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagata

SEQ ID NO: 185240 - DNA, 562 bp, Homo sapiens
  Payload ID: 16477
  Gene Symbol: SPG21
  Gene Name: spastic paraplegia 21 (autosomal recessive, Mast syndrome)
  ENST ID: ENST00000558415
  CDS Start-End: 404-562
ctggggccgaatctgggctgtggggtggtcggtgtgcttgtgaccctgcctttgtgtggctgtcaccggtgggactggcggggagctgtgttagagacggggtttcaccgtgttagccaggatggcctcgatctcctgacctcgtgatccgcccgcctcggcctcccaaagggctgagattacaggcgtgagccatcgcggctggccactgaggagtaacttaatagctgtgtccaaattccaaaagcttttttcccaagagcatgagaagagatgtcacagatgtcagtcacagcggagtggaatctctccatcttgtaagattacttttaacacgttggcatcctgaggtggttgtgaattattctgaagactgttggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagt

SEQ ID NO: 185241 - DNA, 553 bp, Homo sapiens
  Payload ID: 16477
  Gene Symbol: SPG21
  Gene Name: spastic paraplegia 21 (autosomal recessive, Mast syndrome)
  ENST ID: ENST00000559677
  CDS Start-End: 246-553
aaaggaagcggaggctttgagtggaggactacggagagcgtctacggttgtgccaaaggaaaaaaaatgttcctaagaaaagagtatacaaagttgtgttcatcaaagtctggaacccaaaggtgtccctccaaagctgtacacgacagagaaaacgcgaactgaaagaagaagcaggtcccaaggggccaggcgcctcctccacctcctcctcctcctaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagt

SEQ ID NO: 185242 - DNA, 544 bp, Homo sapiens
  Payload ID: 16477
  Gene Symbol: SPG21
  Gene Name: spastic paraplegia 21 (autosomal recessive, Mast syndrome)
  ENST ID: ENST00000558943
  CDS Start-End: 330-544
gatttggaaaagtatacccctttggtggatgaaagagagctaggagaacaaactttcctattcataccactcacagctgttttccctttgcagcagtgatctttttttcacttagacgtcagttggtcagatgcaacatttggtatccattttacctttcatgtactgccaaactagcacaagtgttaaaattacttgtctctacaaaaatttagtcacagcggagtggaatctctccatcttgtaagattacttttaacacgttggcatcctgaggtggttgtgaattattctgaagactgttggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccg

SEQ ID NO: 185243 - DNA, 747 bp, Homo sapiens
  Payload ID: 16477
  Gene Symbol: SPG21
  Gene Name: spastic paraplegia 21 (autosomal recessive, Mast syndrome)
  ENST ID: ENST00000557795
  CDS Start-End: 324-747
gagtgtgtgtctggggccgaatctgggctgtggggtggtcggtgtgcttgtgaccctgcctttgtgtggctgtcaccggtgggactggcggggagctgtgttagagacggggtttcaccgtgttagccaggatggcctcgatctcctgacctcgtgatccgcccgcctcggcctcccaaagggctgagattacaggcgtgagccatcgcggctggccactgaggagtaacttaatagctgtgtccaaattccaaaagcttttttcccaagagcatgagaagagatgtcacagatgtcaggattaacctccatttcagctaatcatgggagagattaaagtctctcctgattataactggtttagaggtacagttccccttaaaaagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctcta

SEQ ID NO: 185244 - DNA, 541 bp, Homo sapiens
  Payload ID: 16477
  Gene Symbol: SPG21
  Gene Name: spastic paraplegia 21 (autosomal recessive, Mast syndrome)
  ENST ID: ENST00000560878
  CDS Start-End: 422-541
actgcaagctctgtctgctgggtttacgccattctcctgcctcagcctcccgagtagctggcactacaggctcccgccaccacgcccggctaattttttgtatttttagtagagacggggtttcaccgtgttagccaggatggcctcgatctcctgacctcgtgatccgcccgcctcggcctcccaaagggctgagattacaggcgtgagccatcgcggctggccactgaggagtaacttaatagctgtgtccaaattccaaaagcttttttcccaagagcatgagaagagatgtcacagatgtcagtcacagcggagtggaatctctccatcttgtaagattacttttaacacgttggcatcctgaggtggttgtgaattattctgaagactgttggattaacctccatttcagctaatcatgggagagattaaagtctctcctgattataactggtttagaggtacagttccccttaaaaagattattgtggatgatgatgacagtaagatatggtcgctctatgacgcgggcccccga

SEQ ID NO: 185245 - DNA, 2059 bp, Homo sapiens
  Payload ID: 16477
  Gene Symbol: SPG21
  Gene Name: spastic paraplegia 21 (autosomal recessive, Mast syndrome)
  ENST ID: ENST00000559199
  CDS Start-End: 1002-1466
ttatttatttatttatgtattttaaagagacaggatccaggccgggcgcagtggctcacgcctgtaatcccagcactttgggaggccaaggcgggtggatcatgagctcaggagttcgagaccagcctgaccaatatggtgaaaccccgtctctactaaaaatacaaaaaattagctgggcatgagggtgtgtgcctataatcccagctacttgggaggctgaggcaggagaatcgcttgaacctgggaggcagaggttgtagtgagccaagatcgtgccactgcactccagcctgggctacagagcgagactctgtctcaaaaaaaaaaaaaaaaaaggaggagggggaagaaacagagaagcagcagccctttggaagattataaagtagttctaagtagttctgtggaatacgttagccctgaggaaagaaaaggagatcagaggagtttgtcatgcatgctaatctggtgtgagctccaggttaccttgtaacaaacaaggcagtagtagtaaaattgtcagtgaaatgacagtgtaaaataacataaaaagcaaatttataaggttttccacttttttcttttaaccttccctccagattattgtggatgatgatgacagtaagatatggtcgctctatgacgcgggcccccgaagtatcaggtgtcctctcatattcctgccccctgtcagtggaactgcagatgtctttttccggcagattttggctctgactggatggggttaccgggttatcgctttgcagtatccagtttattgggaccatctcgagttctgtgatggattcagaaaacttttagaccatttacaattggataaagttcatctttttggcgcttctttgggaggctttttggcccagaaatttgctgaatacactcacaaatctcctagagtccattccctaatcctctgcaattccttcagtgacacctctatcttcaaccaaacttggactgcaaacagcttttggctgatgcctgcatttatgctcaaaaaaatagttcttggaaatttttcatctggcccggtggaccctatgatggctgatgccattgatttcatggtagacaggctagaaagtttgggtcagagtgaactggcttcaagacttaccttgaattgtcaaaattcttatgtggaacctcataaaattcgggacatacctgtaactattatggatgtgtttgatcagagtgcgctttcaactgaagctaaagaagaaatgtacaagctgtatcctaatgcccgaagagctcatctgaaaacaggaggcaatttcccatacctgtgcagaagtgcagaggtcaatctttatgtacagatacatttgctgcaattccatggaaccaaatacgcggccattgacccatcaatggtcagtgccgaggagcttgaggtgcagaaaggcagccttggcatcagccaggaggagcagtagtgtgtctctcgctgtcaatgatgagttgacccggtgtgttcttgtatagtcagtggcatcagcacccgtcagccagccttttccttcaggttcgtcaggctcaccggttctcactgtgtctgggaagtaggactgatggtcatcttcatgacaggcggcatctccactaagcctgtgtaactgttccctctttggttttcttagcttttgaatttgaagaagtacttttgaagactcccattttaagaaccgtgcaaattttgctaccaaaagtcttcaccactgtgttcttaagtgaatgttaatttctgaggtttgggactttgtggtggtttttttcttcttttcttttccattcttctttctttctttttatgttgtttgctgtaaatgctgcacatccagattgcatatcaggacattggttattttatgctttcttggatataaccatgatcagagtgccatggccactaccccactgtttgctctcctgcaaatcaactgcttttaatttacacttaaacaaattgttttgagtgttagctactgcctttctagatattagtcatttggaataaaaattcaattta

SEQ ID NO: 185246 - DNA, 3076 bp, Homo sapiens
  Payload ID: 16478
  Gene Symbol: SPG7
  Gene Name: spastic paraplegia 7 (pure and complicated autosomal recessive)
  Uniprot ID: Q9UQ90
  ENST ID: ENST00000268704
  CDS Start-End: 16-2403
ggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggaatgggtaccacagaccatgtcatcgtcctggcgtccacgaaccgagctgacattttggacggtgctctgatgaggccaggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcagggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatcta

SEQ ID NO: 185247 - DNA, 2288 bp, Homo sapiens
  Payload ID: 16478
  Gene Symbol: SPG7
  Gene Name: spastic paraplegia 7 (pure and complicated autosomal recessive)
  Uniprot ID: Q9UQ90
  ENST ID: ENST00000341316
  CDS Start-End: 8-1477
ggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggtgcctctcttgaccagctaccctcccaggggaccatgaggaagctcagaggaaagacccccgcctgctcctgtctcacggagcccacagggtcacggagggcaatggagggtcattcgctctgctggggttgccttttgcactgaagatagagaccacctttttgagtgacttgagcccaaaggcaagcgtatatcaaacgatcttctccacataacctctctgtgccatcataagaatagctgcttccgcccccggatttgctcaggcctgggaatccgctgactgaaggcctcttgttgagtgccagctctaaacaagtccctttatgcagagccacagctgtgcatgctcagccctgccgaggtcccaggccaggctttgttgcttccgttcatggaagcgcacaggatagggccgacgctgtgccggtcgtggggaaatctcactggggaagagaaaagcccaagccttgttggttacgtcagccggtccatggcggtgtcctgcggaccccagagcccccgggaagggcgcaagtcaaagagcactggaggcaccgccggcgatggacgtccaggtcccggctcctgtgctggaaagcgttgatggggagcgtcggcgctgaccacacgcgggagctgcggaagcccagcggttcacacaggcctcccttcaacgtagtcatcccctggtggtggaagcaagacgacggcccctgacgtgcagccacacacagaaaaggctgctgtgaacattttatgcttcgactttttttttcttcagagacagggtgtcgttctgtcgcccaggctggagtgcagtgccaccatcatagctcactgcagcctccacctcctaggctcaagcttcctaagtagttgggactcaaggcttgagtcaccatgccaggctctgttttttcagtctgtgaaaaataaagtcatcagcatgtga

SEQ ID NO: 185248 - DNA, 581 bp, Homo sapiens
  Payload ID: 16478
  Gene Symbol: SPG7
  Gene Name: spastic paraplegia 7 (pure and complicated autosomal recessive)
  ENST ID: ENST00000566371
  CDS Start-End: 189-581
actcaacaagctttccagctcttggcgtcagctctagacctaaggcggacggaggaaggggtcggggtggcggaggaccccgcgcgcctgggagcccacgagggaccctgcccgggcccggagggcggaccctgaagagaacagagcctcttcctaagcttccagacggcgcctccccgcttcctacgatgggctcgcgcagcggccggggcaggaccgaggctcgaagcgcctccgagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctg

SEQ ID NO: 185249 - DNA, 2305 bp, Homo sapiens
  Payload ID: 16478
  Gene Symbol: SPG7
  Gene Name: spastic paraplegia 7 (pure and complicated autosomal recessive)
  ENST ID: ENST00000569820
  CDS Start-End: 1-212
gaatgggtaccacagaccatgtcatcgtcctggcgtccacgaaccgagctgacattttggacggtgctctgatgaggccaggccgactggaccggcacgtcttcattgatctccccacgctgcagagaaagggtgttgcgctgtcacccaggctggagtgcagtgctgcgatcaccactcactgcggcctcaaccttcagggctcaagctgaggagctaggactactatgggcgtgcgccgccgtgctggttaatttttaacagagtctcgctgtgttgccaaggctggagtgcagcggcgcgatctcggctcactgcaaccaccatctcccaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcaggtccccagggcttcagcttgggaaagcagtgggttcctgcagaggagtggggcagctgctgtgccagacactgcaaaacacacctggcttctctccgacagccctgcgggtcgagaggactggcgctgcctgtgtcttactgaaatttattttcgtgtaaccatttacttttatgtggaaatcgaaaagcttttgataatagtagcaaagcaggaaggactgagtgggaaccacaagccagttgaaagaaaatacatgacgtacttgagtgctcaggaccacgagctgattcaagttgtacagaatggacacttacagatgtgtggaaaatctgagacaggaaatgaagcctcaccaggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatctaca

SEQ ID NO: 185250 - DNA, 734 bp, Homo sapiens
  Payload ID: 16478
  Gene Symbol: SPG7
  Gene Name: spastic paraplegia 7 (pure and complicated autosomal recessive)
  ENST ID: ENST00000566221
  CDS Start-End: 1-320
caggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcagccctgcgggtcgagaggactggcgctgcctgtgtcttactgaaatttattttcgtgtaaccatttacttttatgtggaaatcgaaaagcttttgataatagtagcaaagcaggaaggactgagtgggaaccacaagccagttgaaagaaaatacatgacgtacttgagtgctcaggaccacgagctgattcaagttgtacagaatggacacttacagatgtgtggaaaatctgagacaggaaatgaagcctcaccaggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtg

SEQ ID NO: 185251 - DNA, 1025 bp, Homo sapiens
  Payload ID: 16478
  Gene Symbol: SPG7
  Gene Name: spastic paraplegia 7 (pure and complicated autosomal recessive)
  ENST ID: ENST00000561911
  CDS Start-End: 1-633
cgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcagggactgccaaaaagagcaagatcctgtccaaggaagaacagaaagtggttgcgtttcatgagtcgggccacgccttggtgggctggatgctggagcacacggaggccgtgatgaaggtctccataacccctcggacaaacgccgccctgggctttgctcagatgctccccagagaccagcacctcttcaccaaggagcagctgtttgagcggatgtgcatggccctgggaggacgggcctcggaagcactgtccttcaacgaggtcacttctgcactgctctgcgcctgcagtgctgaggatgcctctgtctcgaccccgccctccaggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccggga

SEQ ID NO: 185252 - DNA, 544 bp, Homo sapiens
  Payload ID: 16478
  Gene Symbol: SPG7
  Gene Name: spastic paraplegia 7 (pure and complicated autosomal recessive)
  ENST ID: ENST00000568151
  CDS Start-End: 1-544
ctgtgggcccgcggatcccccagctgtggacctcggcgcggagcgactgttggggccctggatcgtgggcgctgggcgggccgggaagaggcagggctgggatccgcgcagtcctcggcgtggactttcccaacccgtctgttgtgtgtggatgttctccgcccgtcttcctcgccttttaaagtggaatccagtaacggtttccggcgtagcactaatttacagtccacgcctgtggatcgattccgtcaccaggaattccagcgccttccagttaggagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcgg

SEQ ID NO: 185253 - DNA, 756 bp, Homo sapiens
  Payload ID: 16478
  Gene Symbol: SPG7
  Gene Name: spastic paraplegia 7 (pure and complicated autosomal recessive)
  ENST ID: ENST00000566682
  CDS Start-End: 1-464
tgtttgagcggatgtgcatggccctgggaggacgggcctcggaagcactgtccttcaacgaggtcacttctggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcggtgaggccctggccaggcgtgggggctacggcgtcacacagtgtccacacagcacccacggtccccacccctctcgtgaagtatttccaaggcacacagagtacagagaacactctgaccgatgtgaattctacccagctcaactgaaacttacgtgttccatactttttatcctgaactcgtcaagtgtgttcccccgaggtagaaagaaggctgccacagtctcctgtgcctcttcctgccattagcaattaccaatgttttgtcagttttgtttaatcttttcccaagtcttacacttttttcttgaacatttttttaaaacaaagctttaattttagagtaggaatttttttttctttttttttttgagacaaagtcttgctctgtcacccaggctggagtgcgatggcgacatcttggctcactgcaacctctg

SEQ ID NO: 185254 - DNA, 3420 bp, Homo sapiens
  Payload ID: 16478
  Gene Symbol: SPG7
  Gene Name: spastic paraplegia 7 (pure and complicated autosomal recessive)
  ENST ID: ENST00000620811
  CDS Start-End: 1598-2314
aggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattgttgttgaaacaacatttagttcagaatccagtcagactctggcaacttttaggtggtactttctattttaacacctcaaggttgaagcagaagaataaggagaaggataagtcgaaggggaaggcgcctgaagaggacgaagaggagaggagacgccgtgagcgggacgaccagatgtaccgagagcggctgcgcaccttgctggtcatcgcggttgtcatgagcctcctgaatgctctcagcaccagcggaggcagcatttcctggaacgactttgtccacgagatgctggccaagggcgaggtgcagcgcgtccaggtggtgcctgagagcgacgtggtggaagtctacctgcaccctggagccgtggtgtttgggcggcctcggctagccttgatgtaccgaatgcaggttgcaaatattgacaagtttgaagagaagcttcgagcagctgaagatgagctgaatatcgaggccaaggacaggatcccagtttcctacaagcgaacaggattctttggaaatgccctgtactctgtggggatgacggcagtgggcctggccatcctgtggtatgttttccgtctggccgggatgactggaagggaaggtggattcagtgcttttaatcagcttaaaatggctcgtttcaccattgtggatgggaagatggggaaaggagtcagcttcaaagacgtggcaggaatgcacgaagccaaactggaagtccgcgagtttgtggattatctgaagagcccagaacgcttcctccagcttggcgccaaggtcccaaagggcgcactgctgctcggcccccccggctgtgggaagacgctgctggccaaggcggtggccacggaggctcaggtgcccttcctggcgatggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggaatgggtaccacagaccatgtcatcgtcctggcgtccacgaaccgagctgacattttggacggtgctctgatgaggccaggccgactggaccggcacgtcttcattgatctccccacgctgcaggagaggcgggagatttttgagcagcacctgaagagcctgaagctgacccagtccagcaccttttactcccagcgtctggcagagctgacaccaggattcagtggggctgacatcgccaacatctgcaatgaggctgcgctgcacgcggcgcgggagggacacacttccgtgcacactctcaacttcgagtacgccgtggagcgcgtcctcgcaggtccccagggctcagcttgggaaagcagtgggttcctgcagaggagtggggagctgctgtgccagacactgcaaaacacacctggcttctctccgacagccctgcggggagaggactggcgctgcctgtgtcttactgatttattttcgtgtaaccatttacttttatgtggaaatcgaaaagcttttgataatagtagcaaagcaggaaggactgagtgggaaccacaagccagttgaaagaaaatacatgacgtacttgagtgctcaggaccacgagctgattcaagttgtacagaatggacacttacagatgtgtggaaaatctgagacaggaaatgaagcctcaccaggactgccaaaaagagcaagatcctgtccaaggaagaacagaaagtggttgcgtttcatgagtcgggccacgccttggtgggctggatgctggagcacacggcgtgatgaaggtctccataacccctcgacaaacgccgccctgggctttgctcaggctccccagagaccagcacctcttcacgagcagctgtttgagcggatgtgcatggccctgggaggacgggcctcggaagcactgtcccaacgaggtcacttctgggggcacaggacgacctgaggaaggtcacccgcatcgcctactccatggtgaagcagtttgggatggcacctggcatcgggcccatctccttccctgaggcgcaggagggcctcatgggcatcgggcggcgccccttcagccaaggcctgcagcagatgatggaccatgaagcaagactgctggtggccaaggcctacagacacaccgagaaggtgctgcaggacaacctggacaagttgcaggcgctggcaaacgcccttctggaaaaggaagtgataaactatgaggacattgaggctctcattggcccgccgccccatgggccgaagaaaatgatcgcaccgcagaggtggatcgacgcccagagggagaaacaggacttgggcgaggaggagaccgaagagacccagcagcctccacttggaggcgaagagccgacttggcccaagtagttgggaggtgttggctgcacgtgcgggtggtccgggaagtgagggctcactcagccaccctgagttgcttttcagctgaggtttgcacttcctctcgcggccctcagtagtccctgcacagtgacttctgagatctgttgattgatgacccttttcatgattttaagtttctctgcagaaactactgacggagtcctgtgtttgtgagtcgtttcccctatggggaaggttatcagtgcttcccgagtgagcatggaacacttcgagttcccagggttatagacagtcgttcccagtgtggctgaggccacccagaggcagcagagcattcagactccaaacagacccctgttcatgccgacgcttgcacgaccgccccagttcctgtggctccctcggaatgctaaggggatcggacatgaaaggaccctgtgagccgattgtcctatctccagcggccctgtcatccagctcactcatcaatggggccagtcaggcccaggcactgggctccggaggactcaccactgccccctgctgccatgtggactggtgcaagttgaggacttcttgctggtctagtcacgcatgcagtgttggggatgccttggtttttactgctctgagaattgttgagatactttactaataaactgtgtagttggaaaatct

SEQ ID NO: 185255 - DNA, 1361 bp, Homo sapiens
  Payload ID: 16478
  Gene Symbol: SPG7
  Gene Name: spastic paraplegia 7 (pure and complicated autosomal recessive)
  ENST ID: ENST00000567138
  CDS Start-End: 1-328
ggccggcccagagttcgtggaggtcattggaggcctcggcgctgcccgtgtgcggagcctctttaaggaagcccgagcccgggccccctgcatcgtctacatcgatgagatcgacgcggtgggcaagaagcgctccaccaccatgtccggcttctccaacacggaggaggagcagacgctcaaccagcttctggtagaaatggatggtcagtgctcgtgcgccccgcacccccattgcaccatcagaggaggttttccgatgtctttcagaacaggttgtggtgagccaagatcgtgtcactgcactccggcctgggtgacagagtgagactctgtctcaagaaaaaaaaaaaatagaaatgtagctttcagacccggcgcagtggctcacgcctgtaatcccagcactttgggaggccaagacaggcggatcaccagaggtcaggatttcatgagcagcctggccaacatgctgaaaccccatctctacaaaaatacaaaagtcagccgggtgtggtggcaggtgcttataatcgctagtactctggagaatcgcttgaactcgggaggtggaggttgcagtgagccaagatctcaccattgcactccagcctgcctgggtgacagagggagactccatctcaaaaaaaaaaaaaaaaaaaacacagcttttaattaaaaaaaggtcaagacaatagtaaaaaagacaagtaggaatataagtggtacgtcagatgtaatctttccttttcttttttagatagtcttgctctctctcccaggctggagcgcagtggcacaatcttggctcactgcaggctctgtctcccgggttctcgccattctcctgcctcagcctctcgagtagctgagactacaggcgcctgtcaccacgcctggctaattttttgtatttttagtagagacggggtttcaccgtgttagccaggatggtctcgatctcctgacctcgtgatccgcctgcctcggcctcccaaagtgctgagattacagacgtgagccttagcacccaggctttttttttcattattactgttttttaggggctttgcagcaaaacccagagggactgctagacagattctggaagagctgtgccactcataattttaggtgtaatgagtctgtctggttgtgctgccacgtctctccctgtgccccctggagagggtgtgacgctggttagagggcggagcagagcatcagggtgctgcactgcagcgagggagacaccccatttgttgtgaccccttgaaaatgacttctggtctggctttgacaatttttttttttaatggagctgacccaataaaggtgacatggaattatttttcttctga

SEQ ID NO: 185256 - DNA, 5117 bp, Homo sapiens
  Payload ID: 16479
  Gene Symbol: SPAST
  Gene Name: spastin
  Uniprot ID: Q9UBP0
  ENST ID: ENST00000315285
  CDS Start-End: 126-1976
gctcctgagaccggcgggcacacgggggtctgtggcccccgccgtagcagtggctgccgccgtcgcttggttcccgtcggtctgcgggaggcgggttatggcggcggcggcagtgagagctgtgaatgaattctccgggtggacgagggaagaagaaaggctccggcggcgccagcaacccggtgcctcccaggcctccgcccccttgcctggcccccgcccctcccgccgccgggccggcccctccgcccgagtcgccgcataagcggaacctgtactatttctcctacccgctgtttgtaggcttcgcgctgctgcgtttggtcgccttccacctggggctcctcttcgtgtggctctgccagcgcttctcccgcgccctcatggcagccaagaggagctccggggccgcgccagcacctgcctcggcctcggccccggcgccggtgccgggcggcgaggccgagcgcgtccgagtcttccacaaacaggccttcgagtacatctccattgccctgcgcatcgatgaggatgagaaagcaggacagaaggagcaagctgtggaatggtataagaaaggtattgaagaactggaaaaaggaatagctgttatagttacaggacaaggtgaacagtgtgaaagagctagacgccttcaagctaaaatgatgactaatttggttatggccaaggaccgcttacaacttctagagaagatgcaaccagttttgccattttccaagtcacaaacggacgtctataatgacagtactaacttggcatgccgcaatggacatctccagtcagaaagtggagctgttccaaaaagaaaagaccccttaacacacactagtaattcactgcctcgttcaaaaacagttatgaaaactggatctgcaggcctttcaggccaccatagagcacctagttacagtggtttatccatggtttctggagtgaaacagggatctggtcctgctcctaccactcataagggtactccgaaaacaaataggacaaataaaccttctacccctacaactgctactcgtaagaaaaaagacttgaagaattttaggaatgtggacagcaaccttgctaaccttataatgaatgaaattgtggacaatggaacagctgttaaatttgatgatatagctggtcaagacttggcaaaacaagcattgcaagaaattgttattcttccttctctgaggcctgagttgttcacagggcttagagctcctgccagagggctgttactctttggtccacctgggaatgggaagacaatgctggctaaagcagtagctgcagaatcgaatgcaaccttctttaatataagtgctgcaagtttaacttcaaaatacgtgggagaaggagagaaattggtgagggctctttttgctgtggctcgagaacttcaaccttctataatttttatagatgaagttgatagccttttgtgtgaaagaagagaaggggagcacgatgctagtagacgcctaaaaactgaatttctaatagaatttgatggtgtacagtctgctggagatgacagagtacttgtaatgggtgcaactaataggccacaagagcttgatgaggctgttctcaggcgtttcatcaaacgggtatatgtgtctttaccaaatgaggagacaagactacttttgcttaaaaatctgttatgtaaacaaggaagtccattgacccaaaaagaactagcacaacttgctagaatgactgatggatactcaggaagtgacctaacagctttggcaaaagatgcagcactgggtcctatccgagaactaaaaccagaacaggtgaagaatatgtctgccagtgagatgagaaatattcgattatctgacttcactgaatccttgaaaaaaataaaacgcagcgtcagccctcaaactttagaagcgtacatacgttggaacaaggactttggagataccactgtttaaggaaatacctttgtaaacctgcagaacattttacttaaaagaggaaacacaagatcttcaatgaacgtcatcggctacagaaacagcctaagtttacaggactttttagagtcttacatatttgtgcaccaaacttgaagatgaaccagaaaacagacttaaacaaaatatacaatgcaaatgtaattttttgttgtttaaggccttgccttgatggtcacagttatcccaatggacactaagttagagcacaacaaaacctgattctggtcttctttaccaatataatcataatgtaaataataatttgtatattgtgttgcagatgaaagtattccaggaacagtgaatggtagaagacacaagaacatttgtttgtttgtcttctgatgttttttcttaaaatagtaatttctcctacttttcttttctactgttgtcttaactacaggtgattggaatgccaaacactcttaagtttattttcttttttcgttttataaattcagtgtgccaaatgaaacttttttcctaagtaactgtaataggaaaaagtttattttgagagtttcttcttcataaatctacagacattaaacaattgttgtgttctttttaccttttatttttctattaccttgctaccaaacagtttagatagcaatataatagcaaaaaagcaaatatggtaaaatagagaaggtttgaaggtttgagttactctgtcatataacatgtagatcagtcttcatgtgacctgcagtatttttttttctaatgtatttgtcagaaatctgttgtagactgttaacttcttcctgatggaatttattttctgcaagaattattctgatatttaagagagccaattttaactgctgtgaaaatgtttccagtgcaagagaagggaaatactaggaactaagacatttctaatttattgcttattactttcttaattttacaggataattataagcaagtggaactaccatcttttattcttaataattattaatcccttcaatgaaactttaaaaaaactgaatttttatacatggcatacatttttctagttccttctgcttgctttattaactcaaaagttctagttctagtctgttgatctgccttttgttctcccaaaatgtacagtaattccatttgtttgtataaatatgcctggattttcattataaaaatgtcattgtagggagtagagactcatatcatggccttttaaatattgtaataaaggcaaatagatatttgcccttagtttactggttaaaagtttgtttacagaacttttctctggtgcttaaatgatgctatgtaaaatgtcatgagtggaaagaatatttgtagtagtaacaagaatttttcatttaggaaagatttcttaggttttgaaagaatacattaaaataaaaaacttgcccctactaggtaagaactttataatgaagacatacattcttcttaattttactcttgctcttgttaaagatttgtttgaatatagaagatgcatgatttctgggtttttttttttttttgagacagagtttcgctcttgttgcccaggctggagtgcaatggcgcaatctcgactcaccacaacctccgcctcccaggttcaagcaattctcctgcctcagcctcccgagtagctgggattacaggcatgcgccactaccccagctaattttgtatttttagtagagatggggtttctccatgttggtcaggctggtcttgaactcctgacctcaggtgatccgcctgcctcggcctcccaaagtgctgggattacaggcataagccactgcgcccagccagaagatgcatgatttcttaggatcatatgctgtttgtagccataaggtaaatcatgtctcttccaatcatgactttggaactccctgaataataaaaatgagagttgagataaataggggaaaaaaaatttttttcaagccagagctatgcatatgttaggtgatgggtagtatccctttaaggtctcaaacattacaacatcaattatgaaatactgataacgaaaggtagtaatgaaatatatatgatgaaaagaattgagaagttctaaattaagacatttcagttaagctcataaaatttcattgttttcatttaaaagattaacgttattgatacttggataactggctaatcatattaaaggactatgtggttccagctcaacttttaatatattgtctcctttaaaactatcatggttataattctattgggaaagacttttagataacaaagatttcaaatgttaaaagagataaaagtcaggttaatactatcttaaacactgagtcagaaaatcattactgtatagaagttgctttcctgatcaagtctgaacttcagctagtgctagagaactattttctatgacttaactctaaccaagttttattttaagctgtttctttgatagaagggccatgaaaatagagtaatgatatagtaggagataagggattggtttggtctttttcaataaagatagaagttgctgaagttttctgaattaataatgacttagattgtgaccttttagattcggtgttgagctctgtgttgtattacttcctaaaagataatgcttaaacattaagcattagtgtgctcttcatgttaatatggcagagttttgtaaactaaattaaaacttactgatatattggactttgagccaagggaaagaatgagtactatctttccagatatcttaagggtaaaagcttattctaagacagtctgtccattgagaatattagatttctgacttgcaaatatgtttgtactccagaagaattagaggaaaagcagatactagaattctaatttaattacatatacagccgtctttgtttatagtgtagaattctttatattttgtacaaaaactaattcttttggtaaaatgaaccatttacagttcggttttggactctgagtcaaaggattttcctttaaatgcttgtctcaattttagtctggtcttttgtacttttcttcagaagaaatgaattaaagggtacagttgcataaagtgggtttttatcctaatgtattggaaataaatgataaacttta

SEQ ID NO: 185257 - DNA, 5116 bp, Homo sapiens
  Payload ID: 16479
  Gene Symbol: SPAST
  Gene Name: spastin
  Uniprot ID: Q9UBP0
  ENST ID: ENST00000345662
  CDS Start-End: 222-1976
ggcccgagccaccgactgcaggaggagaaggggttgtgctcctggccgaggaaggagaaaggggcggggccggcgggcagcgtgcggcagtgcggagctcctgagaccggcgggcacacgggggtctgtggcccccgccgtagcagtggctgccgccgtcgcttggttcccgtcggtctgcgggaggcgggttatggcggcggcggcagtgagagctgtgaatgaattctccgggtggacgagggaagaagaaaggctccggcggcgccagcaacccggtgcctcccaggcctccgcccccttgcctggcccccgcccctcccgccgccgggccggcccctccgcccgagtcgccgcataagcggaacctgtactatttctcctacccgctgtttgtaggcttcgcgctgctgcgtttggtcgccttccacctggggctcctcttcgtgtggctctgccagcgcttctcccgcgccctcatggcagccaagaggagctccggggccgcgccagcacctgcctcggcctcggccccggcgccggtgccgggcggcgaggccgagcgcgtccgagtcttccacaaacaggccttcgagtacatctccattgccctgcgcatcgatgaggatgagaaagcaggacagaaggagcaagctgtggaatggtataagaaaggtattgaagaactggaaaaaggaatagctgttatagttacaggacaaggtgaacagtgtgaaagagctagacgccttcaagctaaaatgatgactaatttggttatggccaaggaccgcttacaacttctagaaagtggagctgttccaaaaagaaaagaccccttaacacacactagtaattcactgcctcgttcaaaaacagttatgaaaactggatctgcaggcctttcaggccaccatagagcacctagttacagtggtttatccatggtttctggagtgaaacagggatctggtcctgctcctaccactcataagggtactccgaaaacaaataggacaaataaaccttctacccctacaactgctactcgtaagaaaaaagacttgaagaattttaggaatgtggacagcaaccttgctaaccttataatgaatgaaattgtggacaatggaacagctgttaaatttgatgatatagctggtcaagacttggcaaaacaagcattgcaagaaattgttattcttccttctctgaggcctgagttgttcacagggcttagagctcctgccagagggctgttactctttggtccacctgggaatgggaagacaatgctggctaaagcagtagctgcagaatcgaatgcaaccttctttaatataagtgctgcaagtttaacttcaaaatacgtgggagaaggagagaaattggtgagggctctttttgctgtggctcgagaacttcaaccttctataatttttatagatgaagttgatagccttttgtgtgaaagaagagaaggggagcacgatgctagtagacgcctaaaaactgaatttctaatagaatttgatggtgtacagtctgctggagatgacagagtacttgtaatgggtgcaactaataggccacaagagcttgatgaggctgttctcaggcgtttcatcaaacgggtatatgtgtctttaccaaatgaggagacaagactacttttgcttaaaaatctgttatgtaaacaaggaagtccattgacccaaaaagaactagcacaacttgctagaatgactgatggatactcaggaagtgacctaacagctttggcaaaagatgcagcactgggtcctatccgagaactaaaaccagaacaggtgaagaatatgtctgccagtgagatgagaaatattcgattatctgacttcactgaatccttgaaaaaaataaaacgcagcgtcagccctcaaactttagaagcgtacatacgttggaacaaggactttggagataccactgtttaaggaaatacctttgtaaacctgcagaacattttacttaaaagaggaaacacaagatcttcaatgaacgtcatcggctacagaaacagcctaagtttacaggactttttagagtcttacatatttgtgcaccaaacttgaagatgaaccagaaaacagacttaaacaaaatatacaatgcaaatgtaattttttgttgtttaaggccttgccttgatggtcacagttatcccaatggacactaagttagagcacaacaaaacctgattctggtcttctttaccaatataatcataatgtaaataataatttgtatattgtgttgcagatgaaagtattccaggaacagtgaatggtagaagacacaagaacatttgtttgtttgtcttctgatgttttttcttaaaatagtaatttctcctacttttcttttctactgttgtcttaactacaggtgattggaatgccaaacactcttaagtttattttcttttttcgttttataaattcagtgtgccaaatgaaacttttttcctaagtaactgtaataggaaaaagtttattttgagagtttcttcttcataaatctacagacattaaacaattgttgtgttctttttaccttttatttttctattaccttgctaccaaacagtttagatagcaatataatagcaaaaaagcaaatatggtaaaatagagaaggtttgaaggtttgagttactctgtcatataacatgtagatcagtcttcatgtgacctgcagtatttttttttctaatgtatttgtcagaaatctgttgtagactgttaacttcttcctgatggaatttattttctgcaagaattattctgatatttaagagagccaattttaactgctgtgaaaatgtttccagtgcaagagaagggaaatactaggaactaagacatttctaatttattgcttattactttcttaattttacaggataattataagcaagtggaactaccatcttttattcttaataattattaatcccttcaatgaaactttaaaaaaactgaatttttatacatggcatacatttttctagttccttctgcttgctttattaactcaaaagttctagttctagtctgttgatctgccttttgttctcccaaaatgtacagtaattccatttgtttgtataaatatgcctggattttcattataaaaatgtcattgtagggagtagagactcatatcatggccttttaaatattgtaataaaggcaaatagatatttgcccttagtttactggttaaaagtttgtttacagaacttttctctggtgcttaaatgatgctatgtaaaatgtcatgagtggaaagaatatttgtagtagtaacaagaatttttcatttaggaaagatttcttaggttttgaaagaatacattaaaataaaaaacttgcccctactaggtaagaactttataatgaagacatacattcttcttaattttactcttgctcttgttaaagatttgtttgaatatagaagatgcatgatttctgggtttttttttttttttgagacagagtttcgctcttgttgcccaggctggagtgcaatggcgcaatctcgactcaccacaacctccgcctcccaggttcaagcaattctcctgcctcagcctcccgagtagctgggattacaggcatgcgccactaccccagctaattttgtatttttagtagagatggggtttctccatgttggtcaggctggtcttgaactcctgacctcaggtgatccgcctgcctcggcctcccaaagtgctgggattacaggcataagccactgcgcccagccagaagatgcatgatttcttaggatcatatgctgtttgtagccataaggtaaatcatgtctcttccaatcatgactttggaactccctgaataataaaaatgagagttgagataaataggggaaaaaaaatttttttcaagccagagctatgcatatgttaggtgatgggtagtatccctttaaggtctcaaacattacaacatcaattatgaaatactgataacgaaaggtagtaatgaaatatatatgatgaaaagaattgagaagttctaaattaagacatttcagttaagctcataaaatttcattgttttcatttaaaagattaacgttattgatacttggataactggctaatcatattaaaggactatgtggttccagctcaacttttaatatattgtctcctttaaaactatcatggttataattctattgggaaagacttttagataacaaagatttcaaatgttaaaagagataaaagtcaggttaatactatcttaaacactgagtcagaaaatcattactgtatagaagttgctttcctgatcaagtctgaacttcagctagtgctagagaactattttctatgacttaactctaaccaagttttattttaagctgtttctttgatagaagggccatgaaaatagagtaatgatatagtaggagataagggattggtttggtctttttcaataaagatagaagttgctgaagttttctgaattaataatgacttagattgtgaccttttagattcggtgttgagctctgtgttgtattacttcctaaaagataatgcttaaacattaagcattagtgtgctcttcatgttaatatggcagagttttgtaaactaaattaaaacttactgatatattggactttgagccaagggaaagaatgagtactatctttccagatatcttaagggtaaaagcttattctaagacagtctgtccattgagaatattagatttctgacttgcaaatatgtttgtactccagaagaattagaggaaaagcagatactagaattctaatttaattacatatacagccgtctttgtttatagtgtagaattctttatattttgtacaaaaactaattcttttggtaaaatgaaccatttacagttcggttttggactctgagtcaaaggattttcctttaaatgcttgtctcaattttagtctggtcttttgtacttttcttcagaagaaatgaattaaagggtacagttgcataaagtgggtttttatcctaatgtattggaaataaatgataaacttt

SEQ ID NO: 185258 - DNA, 5212 bp, Homo sapiens
  Payload ID: 16479
  Gene Symbol: SPAST
  Gene Name: spastin
  Uniprot ID: Q9UBP0
  ENST ID: ENST00000615843
  CDS Start-End: 222-2072
ggcccgagccaccgactgcaggaggagaaggggttgtgctcctggccgaggaaggagaaaggggcggggccggcgggcagcgtgcggcagtgcggagctcctgagaccggcgggcacacgggggtctgtggcccccgccgtagcagtggctgccgccgtcgcttggttcccgtcggtctgcgggaggcgggttatggcggcggcggcagtgagagctgtgaatgaattctccgggtggacgagggaagaagaaaggctccggcggcgccagcaacccggtgcctcccaggcctccgcccccttgcctggcccccgcccctcccgccgccgggccggcccctccgcccgagtcgccgcataagcggaacctgtactatttctcctacccgctgtttgtaggcttcgcgctgctgcgtttggtcgccttccacctggggctcctcttcgtgtggctctgccagcgcttctcccgcgccctcatggcagccaagaggagctccggggccgcgccagcacctgcctcggcctcggccccggcgccggtgccgggcggcgaggccgagcgcgtccgagtcttccacaaacaggccttcgagtacatctccattgccctgcgcatcgatgaggatgagaaagcaggacagaaggagcaagctgtggaatggtataagaaaggtattgaagaactggaaaaaggaatagctgttatagttacaggacaaggtgaacagtgtgaaagagctagacgccttcaagctaaaatgatgactaatttggttatggccaaggaccgcttacaacttctagagaagatgcaaccagttttgccattttccaagtcacaaacggacgtctataatgacagtactaacttggcatgccgcaatggacatctccagtcagaaagtggagctgttccaaaaagaaaagaccccttaacacacactagtaattcactgcctcgttcaaaaacagttatgaaaactggatctgcaggcctttcaggccaccatagagcacctagttacagtggtttatccatggtttctggagtgaaacagggatctggtcctgctcctaccactcataagggtactccgaaaacaaataggacaaataaaccttctacccctacaactgctactcgtaagaaaaaagacttgaagaattttaggaatgtggacagcaaccttgctaaccttataatgaatgaaattgtggacaatggaacagctgttaaatttgatgatatagctggtcaagacttggcaaaacaagcattgcaagaaattgttattcttccttctctgaggcctgagttgttcacagggcttagagctcctgccagagggctgttactctttggtccacctgggaatgggaagacaatgctggctaaagcagtagctgcagaatcgaatgcaaccttctttaatataagtgctgcaagtttaacttcaaaatacgtgggagaaggagagaaattggtgagggctctttttgctgtggctcgagaacttcaaccttctataatttttatagatgaagttgatagccttttgtgtgaaagaagagaaggggagcacgatgctagtagacgcctaaaaactgaatttctaatagaatttgatggtgtacagtctgctggagatgacagagtacttgtaatgggtgcaactaataggccacaagagcttgatgaggctgttctcaggcgtttcatcaaacgggtatatgtgtctttaccaaatgaggagacaagactacttttgcttaaaaatctgttatgtaaacaaggaagtccattgacccaaaaagaactagcacaacttgctagaatgactgatggatactcaggaagtgacctaacagctttggcaaaagatgcagcactgggtcctatccgagaactaaaaccagaacaggtgaagaatatgtctgccagtgagatgagaaatattcgattatctgacttcactgaatccttgaaaaaaataaaacgcagcgtcagccctcaaactttagaagcgtacatacgttggaacaaggactttggagataccactgtttaaggaaatacctttgtaaacctgcagaacattttacttaaaagaggaaacacaagatcttcaatgaacgtcatcggctacagaaacagcctaagtttacaggactttttagagtcttacatatttgtgcaccaaacttgaagatgaaccagaaaacagacttaaacaaaatatacaatgcaaatgtaattttttgttgtttaaggccttgccttgatggtcacagttatcccaatggacactaagttagagcacaacaaaacctgattctggtcttctttaccaatataatcataatgtaaataataatttgtatattgtgttgcagatgaaagtattccaggaacagtgaatggtagaagacacaagaacatttgtttgtttgtcttctgatgttttttcttaaaatagtaatttctcctacttttcttttctactgttgtcttaactacaggtgattggaatgccaaacactcttaagtttattttcttttttcgttttataaattcagtgtgccaaatgaaacttttttcctaagtaactgtaataggaaaaagtttattttgagagtttcttcttcataaatctacagacattaaacaattgttgtgttctttttaccttttatttttctattaccttgctaccaaacagtttagatagcaatataatagcaaaaaagcaaatatggtaaaatagagaaggtttgaaggtttgagttactctgtcatataacatgtagatcagtcttcatgtgacctgcagtatttttttttctaatgtatttgtcagaaatctgttgtagactgttaacttcttcctgatggaatttattttctgcaagaattattctgatatttaagagagccaattttaactgctgtgaaaatgtttccagtgcaagagaagggaaatactaggaactaagacatttctaatttattgcttattactttcttaattttacaggataattataagcaagtggaactaccatcttttattcttaataattattaatcccttcaatgaaactttaaaaaaactgaatttttatacatggcatacatttttctagttccttctgcttgctttattaactcaaaagttctagttctagtctgttgatctgccttttgttctcccaaaatgtacagtaattccatttgtttgtataaatatgcctggattttcattataaaaatgtcattgtagggagtagagactcatatcatggccttttaaatattgtaataaaggcaaatagatatttgcccttagtttactggttaaaagtttgtttacagaacttttctctggtgcttaaatgatgctatgtaaaatgtcatgagtggaaagaatatttgtagtagtaacaagaatttttcatttaggaaagatttcttaggttttgaaagaatacattaaaataaaaaacttgcccctactaggtaagaactttataatgaagacatacattcttcttaattttactcttgctcttgttaaagatttgtttgaatatagaagatgcatgatttctgggtttttttttttttttgagacagagtttcgctcttgttgcccaggctggagtgcaatggcgcaatctcgactcaccacaacctccgcctcccaggttcaagcaattctcctgcctcagcctcccgagtagctgggattacaggcatgcgccactaccccagctaattttgtatttttagtagagatggggtttctccatgttggtcaggctggtcttgaactcctgacctcaggtgatccgcctgcctcggcctcccaaagtgctgggattacaggcataagccactgcgcccagccagaagatgcatgatttcttaggatcatatgctgtttgtagccataaggtaaatcatgtctcttccaatcatgactttggaactccctgaataataaaaatgagagttgagataaataggggaaaaaaaatttttttcaagccagagctatgcatatgttaggtgatgggtagtatccctttaaggtctcaaacattacaacatcaattatgaaatactgataacgaaaggtagtaatgaaatatatatgatgaaaagaattgagaagttctaaattaagacatttcagttaagctcataaaatttcattgttttcatttaaaagattaacgttattgatacttggataactggctaatcatattaaaggactatgtggttccagctcaacttttaatatattgtctcctttaaaactatcatggttataattctattgggaaagacttttagataacaaagatttcaaatgttaaaagagataaaagtcaggttaatactatcttaaacactgagtcagaaaatcattactgtatagaagttgctttcctgatcaagtctgaacttcagctagtgctagagaactattttctatgacttaactctaaccaagttttattttaagctgtttctttgatagaagggccatgaaaatagagtaatgatatagtaggagataagggattggtttggtctttttcaataaagatagaagttgctgaagttttctgaattaataatgacttagattgtgaccttttagattcggtgttgagctctgtgttgtattacttcctaaaagataatgcttaaacattaagcattagtgtgctcttcatgttaatatggcagagttttgtaaactaaattaaaacttactgatatattggactttgagccaagggaaagaatgagtactatctttccagatatcttaagggtaaaagcttattctaagacagtctgtccattgagaatattagatttctgacttgcaaatatgtttgtactccagaagaattagaggaaaagcagatactagaattctaatttaattacatatacagccgtctttgtttatagtgtagaattctttatattttgtacaaaaactaattcttttggtaaaatgaaccatttacagttcggttttggactctgagtcaaaggattttcctttaaatgcttgtctcaattttagtctggtcttttgtacttttcttcagaagaaatgaattaaagggtacagttgcataaagtgggtttttatcctaatgtattggaaataaatgataaacttt

SEQ ID NO: 185259 - DNA, 1715 bp, Homo sapiens
  Payload ID: 16479
  Gene Symbol: SPAST
  Gene Name: spastin
  Uniprot ID: Q9UBP0
  ENST ID: ENST00000621856
  CDS Start-End: 123-1715
ataagcggaacctgtactatttctcctacccgctgtttgtaggcttcgcgctgctgcgtttggtcgccttccacctggggctcctcttcgtgtggctctgccagcgcttctcccgcgccctcatggcagccaagaggagctccggggccgcgccagcacctgcctcggcctcggccccggcgccggtgccgggcggcgaggccgagcgcgtccgagtcttccacaaacaggccttcgagtacatctccattgccctgcgcatcgatgaggatgagaaagcaggacagaaggagcaagctgtggaatggtataagaaaggtattgaagaactggaaaaaggaatagctgttatagttacaggacaaggtgaacagtgtgaaagagctagacgccttcaagctaaaatgatgactaatttggttatggccaaggaccgcttacaacttctagagaagatgcaaccagttttgccattttccaagtcacaaacggacgtctataatgacagtactaacttggcatgccgcaatggacatctccagtcagaaagtggagctgttccaaaaagaaaagaccccttaacacacactagtaattcactgcctcgttcaaaaacagttatgaaaactggatctgcaggcctttcaggccaccatagagcacctagttacagtggtttatccatggtttctggagtgaaacagggatctggtcctgctcctaccactcataagggtactccgaaaacaaataggacaaataaaccttctacccctacaactgctactcgtaagaaaaaagacttgaagaattttaggaatgtggacagcaaccttgctaaccttataatgaatgaaattgtggacaatggaacagctgttaaatttgatgatatagctggtcaagacttggcaaaacaagcattgcaagaaattgttattcttccttctctgaggcctgagttgttcacagggcttagagctcctgccagagggctgttactctttggtccacctgggaatgggaagacaatgctggctaaagcagtagctgcagaatcgaatgcaaccttctttaatataagtgctgcaagtttaacttcaaaatacgtgggagaaggagagaaattggtgagggctctttttgctgtggctcgagaacttcaaccttctataatttttatagatgaagttgatagccttttgtgtgaaagaagagaaggggagcacgatgctagtagacgcctaaaaactgaatttctaatagaatttgatggtgtacagtctgctggagatgacagagtacttgtaatgggtgcaactaataggccacaagagcttgatgaggctgttctcaggcgtttcatcaaacgggtatatgtgtctttaccaaatgaggagacaagactacttttgcttaaaaatctgttatgtaaacaaggaagtccattgacccaaaaagaactagcacaacttgctagaatgactgatggatactcaggaagtgacctaacagctttggcaaaagatgcagcactgggtcctatccgagaactaaaaccagaacaggtgaagaatatgtctgccagtgagatgagaaatattcgattatctgacttcactgaatccttgaaaaaaataaaacgcagcgtcagccctcaaactttagaagcgtacatacgttggaacaaggactttggagataccactgtttaa

SEQ ID NO: 185260 - DNA, 4256 bp, Homo sapiens
  Payload ID: 16480
  Gene Symbol: SPATA31A1
  Gene Name: SPATA31 subfamily A, member 1
  ENST ID: ENST00000377647
  CDS Start-End: 21-4106
agtccctagtccccacggggatgcccagagctcagttgcttgaaagcaacgcgcctattcacatggagaatcttccctttcctttaaaattacttagtgcctcatcgctaaacgcccccagttccacaccatgggtgttggatatcttcctcactttggtgtttgccctggggttcttcttcctattactcccctacttatcttacttccgttgtgatgacccaccctcaccatcgcctgggaagagaaagtgtccagtagggcggaggcggaggcccagaggcaggatgaaaaaccacagtctgagagctggtagagagtgcccgagaggcctgcaggagacttcggacctgctttcacaactgcagagcctcctggggccacaccttgacaaaggtgactttggtcagctctccggtccagaccccccaggtgaagtgggcgaaagagcacctgatggagcctcccagtcctctcatgagcctatggaagatgctgctcccattctctccccgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctccgcctcctccaaaaggcttcactgctcctcccctgcgggactccacactgataactccatctcactgtgactcagtggcacttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctaccagatggaagctggtagcctgtttttgctcagctctgatggccagaatgccgtggggatacaagtcacagaaacagccaaggtcaacatttgggaagaaaaagaaaatgttggatcatttacagatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccccgtcccatctggggcccgagtgccaaccctttatttcatccacaccccaattccggcccacacctatggctcaggccgaggctcaggcccatcttcaatcttctttcccagtcctatctcctgcttttccatccctgattaagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcgggacgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggacatgaaaagcttcccacggaaggttctgggggtgacttctgaggagtcggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgggcccttgaagcctcctccagctggacaggagggcaggtggccatctaagcccctcacgtacagcctcacaggcagcacccagcagagcaggagcttaggagcccaatcttcaaaggctggagagacaagggaggcagtgccacaatgcagagtccccttggaaacctgtatgctggcaaacctccaagccacaagtgaggatatgcatggtttcgaggctccagggaccagcaaaagctctctacaccctagagtgtctgtctcccaagatccaagaaagctgtgtcttatggaggaggttgttaatgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctgctgggaacatgcgggcttcccaggagctacatgaccttatggcagccagaaggagcaaactggtgcacgaggagcccagaaacccaaactgtcaaggctcatgcaagaaccaaaggccaatgtttccccctattcacaagagtgagaagtctaggaagcccaacttagaaaaacatgaagaaaggcttgaaggattgaggactcctcaacttaccccagtcaggaaaacagaagacacccatcaggatgaaggcgtccagctactgccatcaaagaaacagcctccttcagtaagccactttggaggaaacatcaagcaattttttcagtggattttttcaaagaaaaaaagcaagccagcaccagtcactgctgagagccaaaaaacagtgaaaaacagatcatgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacaggcaaatcagaaatcaacagcccttgaaaagtgtgcggtgcaacaatgagcaatggggcctgcgacatccccaaatcttgcaccccaagaaagctgtatccccagtcagtccccttcagcactggccgaagacatccggtgcctctagccaccatcaccactgtccaaggcactgtcttctttgggaaggtatctgatttggtcagtcacaaattcttttttagccttccctggagaaaaagaagtccccaagaaaaaattcactctatgtagagaaaaaatattttctctcatgttagtacatgcagaacatttaatataccacaatatatatggttttttattca

SEQ ID NO: 185261 - DNA, 4256 bp, Homo sapiens
  Payload ID: 16481
  Gene Symbol: SPATA31A3
  Gene Name: SPATA31 subfamily A, member 3
  Uniprot ID: Q5VYP0
  ENST ID: ENST00000428649
  CDS Start-End: 63-4106
agtccctagtccccacggggatgcccagagctcagttgcttgaaagcaacgcgcctattcacatggagaatcttccctttcctttaaaattacttagtgcctcatcgctaaacgcccccagttccacaccatgggtgttggatatcttcctcactttggtgtttgccctggggttcttcttcctattactcccctacttatcttacttccgttgtgatgacccaccctcaccatcgcctgggaagagaaagtgtccagtagggcggaggcggaggcccagaggcaggatgaaaaaccacagtctgagagctggtagagagtgccggagaggcctggaggagacttcggacctgctttcacaactgcagagcctcctggggccacaccttgacaaaggtgactttggtcagctctccggtccagaccccccaggtgaggtgggcgaaagagcacctgatggagcctcccagtcctctcatgagcctatggaagatgctgctcccattctctccctgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctctgcctcctccaaaaggcttcactgctcctcccctgcgggactccacactgataactccatctcactgtgactcagtggcacttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctgtcagatggaagctggtagcctgtttttgctcagctctgatggccagaatgtcgtggggatacaagtcacagaaacagccaaggtcaacatttgggaagaaaaagaaaatgttggatcatttacaaatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccctgtcccatctggggcccgagtgccaaccctttatttcatccacaccccaattccggcccacacctatggctcaggccgaggctcaggcccatcttcaatcttctttcccagtcctatctcctgcttttccatccctgattcagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcaggacgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggatatgaaaagcttcccacggaaggttctgggggtgacttctgaggagttggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgaacccttgaagcctcctccagctggacaggagggcaggtggccatctaagcccctcacgtacagcctcacaggcagcacccagcagagcaggagcttaggagcccaatcttcaaaggctggagagacaagggaggcagtgccacaatgcagagtccccttggaaacctgtatgctggcaaacctccaagccacaagtgaggatgtgcatggtttcgaggctccagggaccagcaaaagctctctacaccctagagtgtctgtctcccaagatccaagaaagctgtgtcttatggaggaggttgttagtgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctactgggaacatgcgggcttcccaggagctacatgacctcatggcagccagaaggagcaaactggtgcacgaggagcccagaaaaccaaactgtcaaggctcatgcaagagccaaaggccaatgtttccccctattcacaagagtgagaagtttaggaagcccaacttagaaaaacatgaagaaaggcttgaaggattgaggactcctcaacttaccccagtcaggaaaacagaagacacccatcaggatgaaggcgtccagctactgccatcaaagaaacagcctccttcagtaagcccctttggagaaaacatcaagcaaatttttcagtggattttttcaaagaaaaaaagcaagccagcaccagtcactgctgagagccaaaaaacagtaaaaaacagatcatgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacagacaaatcagaaatcaacagcccttgaaaagtgtgcggtgcaacaatgagcaatggggcctgcgacatccccaaatcttgcaccccaagaaagctgtatccccagtcagtccccctcagcactggccgaagacatccggtgcctctagccaccatcaccactgtccaaggcactgtcttctttgggaaggtatctgatttggtcagtcacaaattcttttttagccttccctggagaaaaacaagtccccaagaaaaaattcactctatgtagagaaaaaatattttctctcatgttagtacatgcagaacatttaatattccacaatatatatggttttttattca

SEQ ID NO: 185262 - DNA, 4256 bp, Homo sapiens
  Payload ID: 16482
  Gene Symbol: SPATA31A5
  Gene Name: SPATA31 subfamily A, member 5
  Uniprot ID: Q5VU36
  ENST ID: ENST00000437823
  CDS Start-End: 63-4106
agtccctagtccccacggggatgcccagagctcagttgcttgaaagcaacgcgcctattcacatggagaatcttccctttcctttaaaattacttagtgcctcatcgctaaacgcccccagttccacaccatgggtgttggatatcttcctcactttggtgtttgccctggggttcttcttcctattactcccctacttatcttacttccgttgtgatgacccaccctcaccatcgcctgggaagagaaagtgtccagtagggcggaggcggaggcccagaggcaggatgaaaaaccacagtctgagagctggtagagagtgccggagaggcctggaggagacttcggacctgctttcacaactgcagagcctcctggggccacaccttgacaaaggtgactttggtcagctctccggtccagaccccccaggtgaggtgggcgaaagagcacctgatggagcctcccagtcctctcatgagcctatggaagatgctgctcccattctctccccgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctctgcctcctccaaaaggcttcactgctcctcccctgcgggactccacactgataactccatctcactgtgactcagtggcatttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctgtcagatggaagctggtagcctgtttttgctcagctctgatggccagaatgtcgtggggatacaagtcacagaaacagccaaggtcaacatttgggaagaaaaagaaaatgttggatcatttacaaatcgaatgaccccagaaaagcacttaaattctttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccctgtcccatctggggcccgagtgccaaccctttatttcatccacaccccaattccggcccacacctatggctcaggccgaggctcaggcccatcttcaatcttctttcccagtcctatctcctgcttttccatccctgattcagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcgggatgaatcaccagggacaagtcaggccaagggcaaacccagtccctggcagtcctccatgtccacaggtgaaggcagcaaggaggcacagaaggtgaagttccagctagagagggacccgtgcccacatctggggcaaattctgggtgagaccccacaaaatctatccagggatatgaaaagcttcccacggaaggttctgggggtgacttctgaggagttggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgtgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgaacccttgaagcctcctccagctggacaggagggcaggtggccatctaagcccctcacgtacagcctcacaggcagcatccagcagagcaggagcttaggagcccaatcttcaaaggctggagagacaagggaggcagtgccacaatgcagagtccccttggaaacctgtatgctggcaaacctccaagccacaagtgaggatgtgcatggtttcgaggctccagggaccagcaaaagctctctacaccctagagtgtctgtctcccaagatccaagaaagctgtgtcttatggaggaggttgttaatgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctactgggaacatgcgggcttcccaggagctacatgacctcatggcagccagaaggagcaaactggtgcacgaggagcccagaaacccaaactgtcaaggctcatgcaagagccaaaggccaatgtttccccctattcacaagagtgagaagtctaggaaacccaacttagaaaaacatgaagaaaggcttgaaggattgaggactcctcaacttaccccagtcaggaaaacagaagacacccatcaggatgaaggcgtccagctactgccatcaaagaaacagcctccttcagtaagcccctttggagaaaacatcaagcaaatttttcagtggattttttcaaagaaaaaaagcaagccagcaccagtcactgctgagagccaaaaaacagtaaaaaacagatcacgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacagacaaatcagaaatcaacagcccttgaaaagtgtgcggtgcaacaatgagcaatggggcctgcgacatccccaaatcttgcaccccaagaaagctgtatccccagtcagtccccctcagcactggccgaagacatccggtgcctctagccaccatcaccactgtccaaggcactgtcttctttgggaaggtatctgatttggtcagtcacaaattcttttttagccttccctggagaaaaacaagtccccaagaaaaaattcactctatgtagagaaaaaatattttctctcatgttagtacatgcagaacatttaatattccacaatatatatggttttttattca

SEQ ID NO: 185263 - DNA, 4209 bp, Homo sapiens
  Payload ID: 16483
  Gene Symbol: SPATA31A6
  Gene Name: SPATA31 subfamily A, member 6
  Uniprot ID: Q5VVP1
  ENST ID: ENST00000332857
  CDS Start-End: 30-4061
agttgcttgaaagcaacgtgcctattcacatggagaatcttccctttcctttaaaattacttagtgcctcatcgctaaacgcccccagctccacaccatgggtgttggatatcttcctcaccttggtgtttgccctggggttcttcttcctattactcccctacttatcttacttccattgtgatgacccaccctcaccatcgcctgggaagagaaagtgtccagtagggcggaggcggaggcccagaggcaggatgaaaaaccacagtctgagagctggtagagagtgcccgagaggcctggaggagacttcggaccttctttcacaactgcagagcctcctggggccacaccttgacaaaggtgactttggtcagctctccggtccagaccccccaggtgaggtgggcgaaagagcacctgatggagcctcccagtcctctcatgagcctatggaagatgctgctcccattctctccccgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctccgcctcctccaaaaggcttcactgctcctcccctgcgggactccacactgataactccatctcactgtgactcagtggcacttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcctctttcccgccacccaccagagacctgtcagatggaagctggtagcctgtttttgctcagctctgatggccagaatgtcgtggggatacaagtcacagaaacagccaaggtcaacatttgggaagaaaaagaaaatgttggatcatttacaaatcaaatgaccccagaaaagcacttaaattctttggggaatttggctaaatcattggatgctgagcaggacaccacaaacccaaaacccttctggaacatgggagagaactcgaaacagctgcccggacctcagaagtgctcagatcctaggctcttgcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccctgtcccaccgccaaccctttatttcatccacaccccaattcctgcccacacctatggctcaggccgaggctcaggcccatcttcagtcttctttcccagtcctatctcctgcttttccatccctgattaagaacactggagtagcttgccctgcatcgcagaataaagtgcaagctctctccctacctgaaactcagcaccctgaatggcctttgttgaggaaacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcgggacgaatcaccagggacaagtcaggccaagggcaaacccagtccctggcagtcctccacgtccacaggtgaaagcagcaaggaggcacagaaggtgaagttccagctagagagggacctgtgcccacatctggggcaaattctgggtgagaccccacaaaatctatccagggacatgaaaagcttcccacggaaggttctgggggtgacttctgaggagtcggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgcgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacgcagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgggcccttgaagcctcctccagctggacaggagggcaggtggccatctaagcccctcacgtacagcctcacaggcagcacccagcagagcaggagcttaggagcccaatcttcaaaggctggagagacaagggaggcagtgccacaatgcagagtccccttggaaacctgtatgctggcaaacctccaagccacaagtgaggatgtgcatggtttcgaggctccagggaccagcaaaagctctctacaccctagagtgtctgtctcccaagatccaagaaagctgtgtcttatggaggaggttgttagtgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctactgggaacatgcgggcttcccaggagctacatgacctcatggcagccagaaggagcaaactggtgcaagaggagcccagaaacccaaactgtcaaggctcatgcaagagccaaaggccaatgtttccccctattcacaagagtgagaagtctaggaagcccaacttagaaaaacatgaagaaaggcttgaaggattgaggactcctcaacttaccccagtcaggaaaacagaagacacccatcaggatgaaggcgtccagctactgccatcaaagaaacagcctccttcagtaagccactttggagaaaacatcaagcaattttttcagtggattttttcaaagaaaaaaagcaagccagcaccagtcactgctgagagccaaaaaacagtaaaaaacagatcatgtgtgtacagcagcagtgctgaagctcagggtctcatgacggcagttggacaaatgctggacaagaaaatgtcactttgccatgcgcaccatgcctcgaaggtaaatcagcacaaacagaagtttcaagccccagtctgtgggtttccctgcaaccacaggcacctcttctactcagaacatggcagaatactgagctatgcagccagcagtcaacaagccactctcaagagccagggttgtcccaacagagacaggcaaatcagaaatcaacagcccttgaaaagtgtgcggtgcaacaatgagcaatggggcctgcgacatccccaaatcttgcaccccaagaaagctgtatccccagtcagtccccctcagcactggccgaagacatccggtgcctctagccaccatcaccactgtccaaggcactgtcttctttgggaaggtatctgatttggtcagtcacaaattcttttttagccttccctggagaaaaacaagtccccaagaaaaaattcactctatgtagagaaaaaatattttctctcatgttagtaaatgcagaacatttaatattccacaatatatatggttttttatt

SEQ ID NO: 185264 - DNA, 4256 bp, Homo sapiens
  Payload ID: 16484
  Gene Symbol: SPATA31A7
  Gene Name: SPATA31 subfamily A, member 7
  Uniprot ID: Q8IWB4
  ENST ID: ENST00000619167
  CDS Start-End: 63-4106
agtccctagtccccacggggatgcccagagctcagttgcttgaaagcaacgcgcctattcacatggagaatcttccctttcctttaaaattacttagtgcctcatcgctaaacgcccccagttccacaccatgggtgttggatatcttcctcactttggtgtttgccctggggttcttcttcctattactcccctacttatcttacttccgttgtgatgacccaccctcaccatcgcctgggaagagaaagtgtccagtagggcggaggcggaggcccagaggcaggatgaaaaaccacagtctgagagctggtagagagtgcccgagaggcctggaggagacttcggacctgctttcacaactgcagagcctcctggggccacaccttgacaaaggtgactttggtcagctctccggtccagaccccccaggtgaggtgggtgaaagagcacctgatggagcctcccagtcctctcatgagcctatggaagatgctgctcccattctctccccgttagcttccccggatcctcaagccaagcatcctcaggatctggcctccaccccatcaccaggcccaatgaccacctcagtctcctccctaagtgcctcccagccaccagaaccttcccttcccctagaacacccctcacccgagccacctgcacttttccctcacccaccacacacccctgatcctctggcctgctctctgcctcctccaaaaggcttcactgctcctcccctgcgggactccacactgataactccatctcactgtgactcagtggcatttccactgggcaccgtccctcaaagcttgtctccacatgaggatttggtggcttctgtcccagccatctcaggccttggtggctcaaacagtcatgtttctgcctcctcccggtggcaggagactgccagaacctcgtgcgcctttaactcatcagtccagcaagatcatctttcccgccacccaccagagacctgtcagatggaagctggtagcctgtttttgctcagctctgatggccagaatgtcgtggggatacaagtcacagaaacagccaaggtcaacatttgggaagaaaaagaaaatgttggatcatttacaaatcgaatgaccccagaaaagcacttaaattatttgcggaatttggctaaatcattggatgctgagcaggacaccacaaacccaaaacccttctggaacatgggagagaactcgaaacagctgcccggacctcagaagctctcagatcctaggctctggcaggaaagtttttggaagaattatagccagcttttctggggcctcccctctctgcacagcgagtccctggtggctaacgcctgggtaactgacaggtcttatactttacagtctcctcctttcttgttcaatgaaatgtccaatgtctgcccaattcaaagggagactacaatgtccccactgcttttccaggcccagcccctgtcccatctggggcccgagtgccaaccctttatttcatccacaccccaattccggcccacacctatggctcaggccgaggctcaggcccatcttcaatcttctttcccagtcctatctcctgcttttccatccctgattcagaacactggagtagcttgccctgcatcgcagaataaagtgcaagctctctccctacctgaaactcagcaccctgaatggcctttgttgaggagacaactagaaggtaggttggctttaccctctagggtccaaaaatctcaggacgtctttagtgtctccactcctaaccttccccaggaaagtttgacatccattctgcctgagaactttccagtcagtcctgaactccggagacaactggagcaacacataaaaaagtggatcatccaacactggggcaacctgggaaggatccaagagtctctggatctgatgcagcttcgggatgaatcaccagggacaagtcaggccaagggcaaacccagtccctggcagtcctccatgtccacaggtgaaagcagcaaggaggcacagaaggtgaagttccagctagagagggacccgtgcccacatctggggcaaattctgggtgagaccccacaaaatctatccagggatatgaaaagcttcccacggaaggttctgggggtgacttctgaggagttggaaaggaacttgaggaagcccttgaggagtgactcgggaagtgatttattaagatgcacagagaggactcatatagaaaacatcctgaaagcccacatgggcaggaacttgggccagaccaacgagggcttgatccccgtgtgtgtgcgtcgatcctggcttgctgtcaaccaggctcttcccgtgtccaacacccatgtgaaaaccagcaatctagcagccccgaaaagtgggaaagcctgtgtgaacacagcccaggtgctttccttcctcgagccgtgtactcagcaggggttgggagcccatattgtgaggttttgggccaaacacaggtggggtctacccctcagggtcctcaagcccattcagtgctttaaactggaaaaggtttcatccttgtcccttacacagcttgctggtccctcctcagccacctgtgaatctggggctggctcagaagttgaggtggacatgttccttagaaagccaccaatggcaagtctgagaaagcaggtgctgaccaaagcatctgatcacatgccagagagtcttctggcctcctcacctgcatggaagcagttccagagggcaccgcgaggaatcccatcttggaatgatcatgaacccttgaagcctcctccagctggacaggagggcaggtggccatctaagcccctcacgtacagcctcacaggcagcatccagcagagcaggagcttaggagcccaatcttcaaaggctggagagacaagggaggcagtgccacaatgcagagtccccttggaaacctgtatgctggcaaacctccaagccacaagtgaggatgtgcatggtttcgaggctccagggaccagcaaaagctctctacaccctagagtgtctgtctcccaagatccaagaaagctgtgtcttatggaggaggttgttaatgaatttgagcctggaatggccacaaagtcagagacccagcctcaagtttgtgccgctgttgtgctccttccagatgggcaagcatctgttgtgccccacgcttcagagaatttggtttctcaagtgccccagggccatctccagagcatgcctactgggaacatgcgggcttcccaggagctacatgacctcatggcagccagaaggagcaaactggtgcacgaggagcccagaaacccaaactgtcaaggctcatgcaagagccaaaggccaatgtttccccctattcacaagagtgagaagtctaggaaacccaacttagaaaaacatgaagaaaggcttgaaggattgaggactcctcaacttaccccagtcaggaaaacagaagacacccatcaggatgaaggcgtccagctactgccatcaaagaaacagcctccttcagtaagcccctttggagaaaacatcaagcaaatttttcagtggattttttcaaagaaaaaaagcaagccagcaccagtcactgctgagagccaaaaaacagtaaaaaacagatcacgtgtgtacagcagcagtgctgaagctcagggtctcatgacggcagttggacaaatgctggacgagaaaatgtcactttgccatgcgcgccatgcctcgaaggtaaatcagcacaaacagaagtttcaagccccagtctgtgggtttccctgcaaccacaggcacctcttctactcagaacacggcagaatactgagctatgcagccagcagtcaacaagccactctcaagagccagggttgtcccaacagagacagacaaatcagaaatcaacagcccttgaaaagtgtgcggtgcaacaatgagcaatggggcctgcgacatccccaaatcttgcaccccaagaaagctgtatccccagtcagtccccctcagcactggccgaagacatccggtgcctctagccaccatcaccactgtccaaggcactgtcttctttgggaaggtatctgatttggtcagtcacaaattcttttttagccttccctggagaaaaacaagtccccaagaaaaaattcactctatgtagagaaaaaatattttctctcatgttagtacatgcagaacatttaatattccacaatatatatggttttttattca

SEQ ID NO: 185265 - DNA, 4833 bp, Homo sapiens
  Payload ID: 16485
  Gene Symbol: SPATA31D1
  Gene Name: SPATA31 subfamily D, member 1
  Uniprot ID: Q6ZQQ2
  ENST ID: ENST00000344803
  CDS Start-End: 48-4778
ggcaccctcagtgctcagttgcttcaggcagctgagctattcagaccatggagaatatcctctgttttctgaacagctatactgagacagggctgagccctgactcacattggttggatatcgaccccaacttcatctgcttgagtgggttggggttgtttatactgtacttgttctacgtggtattgaccctgtattcgtcacccaccgaaaaaaataatgacatccaaaagcatcagggcagagccaagaggagaaggaaaggtgggacattcaaaggtttcccagactggaaaagtttccagagagaagaggaagaggaaaggaagctgctttctcttctgaaaagctttggacctcctgtttcctgcagtcctcggggccagcatcatgataccaaccactttcgtcgactgttatgcccagaccccgtctgtcgggtgtgtaagagagcaactgctgatatccagcaactgctgtcttgggagtccctgaaagatgctgctccctctgtgtcccctttggcttcttcggcttctgcgactgagtcatcgttcactctggcttccaccccctcagcaacccctccagaagacctaatactgtcccctcggcctaaggcctctccaccaccccccttaattctctcacctgacctgatcaccaccttagctgacttattttcaccctcaccactgagggaccctctgccaccacagcctgtttctcccttggattccaagttccccatagaccattccccaccccaacagcttccctttccccttctcccaccacatcacattgagagagtggagtccagcctccaacctgaagccagtttgtctctgaacaccatcttttcatttggctccaccctatgccaagatatttcgcaggccatgaatcccattgattcttgtgctcgtcatcacggaccaccaatcccatctgctttaccaccggaagattgcactgtgactcagtctaaatcaagtctcaccatcttgaagacttttccggaaatgttatctctaggtggctctggtgggtcatccacctctgccccaacaatcaaaggcattgaccattcacaccttgcatcttcagaattcacctggtggcagcctcatgccaaggactctttttcctctaattttgtgccatctgatttcatggaggagcttcttacccttcattcttctgaggcctttttaggggggcactctgtggccaacctcatagagcctgttaacatctcatttctcagccatgacattctggcactcctggagagacaagtcaaaaaaaggggtgatttcctgatgtggaaagaaaatggaaagaaaccaggatcattcccaaaacaacttaggccaaactaccaactaaattcctcacggaatatgttaacctcaattgctgttaagcatgacttggcagaatcctttcctttttgggccagtaaaggcaaactagaatggcagcacatccatcagcagcctccacactctaaatgctttgaagaccatttagagcaaaaatatgtccagctcttctggggtctcccatctttgcacagcgagtctctgcatcctactgttcttgtccaacgtggccattcctccatgtttgtattcttcaatggcattacaaatacatctatatcccatgaatccccagtacttccccctccccaacctctgtccttgcctagtacccaaccactacccttgcctcaaaccctgccccaaggtcagtccccacatctcactcaggtgaagtccctggctcaacctcaatctccattccgagccctactacctagtcctctattcctgattaggatctgtggagtgtgttttcatagaccccagaacgaggcacggtctcttttgccatctgaaattaaccatctggagtggaacgtgttgcagaaagtgcaggaaagtttgtggggcttaccctctgtggttcaaaaatcccaggaagacttttgtcctccagctcccaatcctgaattggtcagaaagtccttcaaggtccatgttccgatctccatcattcctggagattttccactcagctctgaggtaaggaagaaactagagcaacacattcgaaggaggctcatccagcgcagatggggcctgccccgcagaatccatgagtctctgtcattgctacgtcctcagagcaaaatttcagagctatctgtgtcagagagaattcatggaccgttaaatatctctttggttgagggtcagaggtgcaatgttctaaagaagtccgcatcaagcttccctagaagcttccacgagaggagctcaaatatgctttccatggagaatgtggggaattatcagggatacagccaggagactgtcccaaaagatcacctgttgcatggtccggagacttcttcagacaaggatctgaggtctaactctgagagagacctagaaactcatatgatgcatctgtcagggaatgactcaggggtgagactaggtcagaaacaacttgaaaatgccctgacagtacgtttgagcaagaaatttgaggaaatcaatgagggtcgaatgcctgggactgtgcatagttcatggcactcagtcaagcagacaatgtctcttcctgagaaatcccacagccaaattaaacatcgaaatctggtaacattggtgagtgaggaccactgcgttgatacttcccaggaaatttccttccttagttccaacaaacaaaagatgttggaagcccatattaaaactttccgtatgaggatgctgtggggccttcccctcaaggtccttgaatccatagaaatcttcaaatcgaaagcggacctttccacttccttttcccatttcgaccttccctcctcagccaccttcatctctcagggagattccaaagatggggtctctaagtcccgtagtcgaagcacttttcaaggagaaaagttgggaacaacaagctcagtccccatccttgatcgtcctcaccctgtctcctcacctgtcgtccaagaagggcaggggaccctgagaagacaattttctgatactgaccatgaccttatagagacagattccaaagacggggcctccacatcccttagaagaggtactacagattttcaaagcgaaaaattagattcaacaagctcattccccatcctcggtcattcttaccttgtcacttcacctgtcaaccaagaaaagcaggggaccctgagaagagaattctctgatactgacaatgatcttacagaaagtgtccggacaacagaggatggcagacagacttttctgcccccgccacacagcatcgtagacgaagtcagtcagaaacagactgtactggccagtagatgcagcgcagagctgcccataatgcaagctggagctggctgtgagtcatgggataagagaaagagttcctttcataatgtagacaggcttcagggcagtagaaagacctttcctgtcaccaatgctcttcaatcacaaactaggaacaacttgacaaccagcaagtcaggaagctgctcactgacaaatgtgaaagcaagcacttccaatgaaactgaaattttcccaccaagaatatcagttcctcaagatcctaaatcatcataccttaaaaatcagatgttgagccagttaaagttggtccagaggaagcatagccaacctcagagccatttcactgacatgtcttttgccttagataacttgagttccaaggacttactgactaattcccagggcatctcgagtggggacatgggaacttcccaggtggtgcatgtccacttggaggacagcggaatccgtgtggcacagaagcaggagcccagggtccctacctgtgtcttacagaagtgtcaagttacgaatttcccaccagctgtaaacagagtgagtcctgtgagacccaaaggaggagagcttgatggaggggatgcagggctggggacatcccaacgcaggagaaagagcctccctgttcataacaagacatcaggggaggtgcttgggagcaaatcttccccaaccttgaaaacacagcctcctcctgaaaaccttttcagaaaatggatgaagacctctttgcagtggtttaataaacccagcatatcatatgaagaacaagaaagttcctgggaaaagggtagctccctgtcatcatgtgtgcagaatattggtcgagttataagagctgcctttactgggactactgaagctcagaaaattaggaaagacactagggagttcctagaagagaagctggggcataggcatgggatagatatcacctgtccccaagagcccctttccttcccagtggggcttgggaaagctcagcacaacccagaagtgcatgtcagagcagagcctgtccagggctgtccctgcaactacagggctccctcctgcaaagtgacacgtaccaaatcttgcagccaacaagctatctttgttggccagaattatcctacaaggattagacagatcatagacaaggacagacagccccagaaagttgaggcatttaaggggaagatactgtgtcaaagccatccccaatccatgccccacaggaagcctgtgccacatccaaaccccacttgccggcgtcaggtcagcctggtgtgtccagccgtcccaaccagtgctaaaagccctgtgtttagtgatgtgcctttcctaactggacagaaaatgcttccaaagcatttacagggaggaaaatttccccccacaaaataattcactccttgttgagaatcttgattctccccaataaatgttccaataagaagga

SEQ ID NO: 185266 - DNA, 4785 bp, Homo sapiens
  Payload ID: 16486
  Gene Symbol: SPATA31D3
  Gene Name: SPATA31 subfamily D, member 3
  Uniprot ID: P0C874
  ENST ID: ENST00000445385
  CDS Start-End: 1-2754
atggagaatatcctctgttttctgaacagctatactgagacagggctgagccctgactcacattgtttggatattgacctcaacttcatctgcttgagtgggttggggttgtttatactgtacttgttctacatggtattgaccctgtattcatcacccaccgaaaaaaataatgacacccaaaagcatcagggcagagccaggaggaaaagaaaaagcgtgacatttaaagaccggaaaagtttgcagaaggaagcagaagaggaaagaaagctacattcttttctgaaaagctttggacctcctgtttcctgcagtcccctgggccagcatcatgataccaccctctttcgtcgactgttatgcccagaccctgtctgtcgggtgtgtaacagagcaactgctgatatccagcgactgctgtcttgggagtccctgaaagatgctgctccctctgtgtcccctttggcttcttcagcttctggggctgagtcatcgttcactctggcttccaccccctcagcaaccactccagaagacctaatattgtcctctcggcctaagccctctccaccaccccccttaattctctcacctgacctgatcaccaccttagctgacttattttcaccctcaccactgagggaccctctgccaccacagcctgtttctcccttggattccaagttccccatagaccattccccaccccaacagcttccctttccccttctcccaccacatcacattgagagagtggagcccagcctccaacctgaggccagtttgtctctgaacaccatcttttcatttggctccaccctatgccaagatatttcccaggccgtgaatcgcactgattcatgtgctcgtcatcatggaccaccaaccccatctgctttaccaccggaagattgcactgtgactcagtctaaatcaaatctcaccgtcttgaagacttttccggaaatgttatctctaggtggctctggtgggtcatccacctctgccccaacaacgaaaggcattgaccattcatgccctgcatcttcagaattctcctggtggcagcctcatgccaaggactctttttcctctaattttgtgccatctgatttcatggaggagcttcttacccttcattcttctgaggcctctttaggggggcactctgtggccaacatcatacagcctgttaacatctcttttctcagccatgacattccggcactcctggagagacaagtcaaaagaaggggtgatttcctgatgtggaaagaaaatggaaagaaaccaggatcattcccaacacaacttaggccaaactaccaactaaattcctcacggaatatgttaacctcaactgctgttaagcatgacttagcagaatcctttcctttttgggccagtaaaggcaaactagagtggcagcacatccatcagcagcccccatattctaagtgttttgaggaccatttagagcaaaaatatgtccagctcttctggggtctcccatctttgcacagcgagtctctgcatcctactgtttttgtccaacatggccgttcctccatgtttgtattcttcaatggcattacaaatacatctatgtcccatgaatccccagtacttccccctccccaacctctgttcttgcctagtacccaacctctacccttgcctcaaaccctgccccgaggtcagtccctacatctcactcaggtgaagtccctggctcaacctcaatctccattcccagccctaccacctagtcctctattcctgattagggtgtgtggcgtgtgttttcatagaccccagaatgaggcacggtctcttatgccatctgaaattaatcatctggagtggaacgtgttgcagaaagtgcaggaaagtgtgtggggtttaccctctgtggttcaaaaatcccaggaagacttttgtcctccagctcccaatcctgtattggtcagaaagtccttcaaggtccatgttcccatctccatcattcctggagattttccactcagctctgaggtaaggaagaaactagagcaacacattcgaaagaggctcatccagcgcagatggggcctgccccgcagaatccatgagtctctgtcattgctacgtcctcagaacaaaatttcagagctatctgtgtcagagagcattcatggtccattaaatatctctttggttgagggtcagaggtgcaatgttctaaagaagtccgcatcaagcttccctagaagcttccacgagaggagctcaaatatgctttccatggagaatgtggggaattatcagggatgcagccaggagactgccccaaaaaaccatctcttgcatgatccggagacatcttcagaggaggatctgaggtctaactctgagagagacctaggaactcatatgatgcatctgtcagggaatgattcaggggtgagactaggtcagaaacaacttgaaaatgccctgacagtacatttgagcaagaaatttgaggaaatcaatgagggtcgaatgcctgggactgtgcatagttcatggcactcagtcaagcagacaatatgtcttcctgagaaatcccacagccaaattaaacatcgaaatttggcagcattggtgagtgaggaccaccgcgttgatacctcccaggagatgtccttccttagttccaacaaacaaaagatgttggaagcccatattaaatctttccatatgaagcccatattaaatctttccatatgaggatgctgtggggccttccccgcaagatccgtgaacccacagaaatcttcaaatcagaagaggatatttccaattccttttcccatttctaccttccctcctcagccagctttatttctcagggagattccaaagatggggtctctaagtcttgtagacgaagcacttttcaaggagaaaagttgggaacaacaagctcagtccctgtccttaatcatcctcagcctgtctcctcacctattggcaaagaagggcaggggaccctgagaagacaattttctgatactgaccatgaccttatagagacagatgccaaagatggtgcctccacgccccttagaagaggcactacatattttcaaggagaaaaattagaaacaacaagctcattctccatcttgggtcatcctcacctcgtcacctcacctgttgatcaagaaaagcaggggaccctcagaagagaattcgctgatactgacgaggatcttacagaaagtgtctggacaactgaggatggcagacagacttttctgccccccacacacagcatcatagacgaagtcagtcagaaacagactgtacttgccagtagatgcagtgcagagctgcccatactgcaagctggagttggccgtgattcaagggataagagagagagtgccagtaataatgttaacaggcttcagggcagtagaaagacctttcctgtcaccaatgggtcgaaggagatgttcaaggaagaggagatctgtactcttcaatcacaaactaggaacaacttgacaaccagcaagtcaggaagctgcttagtgacaaacgtgaaaagaagcacttctcatgaaactgaaattttcccaccaagaatatcagttcctcaaactcctaaatcatcatatcttaaaaatcagatgttgagccagttaaagttggtccagaggaagcatagccaacctcagagccatttcactggcatgtctcttgccttagataacttgagttccaaggacttactgactcatgcccagggcatctcgaatcaggacttgggaacttcccaggtgctgcatgtccacttggaggtcagaggaatccgtgtggcacagcagcaggagcccagggtccctacgcatgtcttacagaaatgccaagttaagaatttttcaccagctacaaagagagtgagccctctaagacctaatggaggagagcttggtggaggggatgcagggctggggacatcccaactcagaagaaagagccatgctattcataacaagacatcaagggagtcgcttgggagcaaatcttccccaaccttgaaaacacagcctcctcctgaaaaccttttcggaacattgatgaagacctttttgcagcagtctaataaacccatcataacatatggaaaacaagaaagttcctaggaaaagggtagctccttgtcatcatctgtgcagaatagaggtcgagttaaaagtagagctgtctttactgggactattgaagctcagaaaattaggaaagacactggggagttcatagaagagaagctggggcatagacattgaatagatatcacctgtccccaggagcccctttcctccccagtgcagcttgggaaatctcagaatgtgccagaactgcaggtcagagcagagcctgtccagggctatccctgcaactacatggctccctcctgcaaagtgacatgtaccaaatcttgcagccaacaagctatctttgtcggccagaattatcctgcaatgattagacagatcatagacaaggacagatagccccaggaagttggacatttaaggggaagatattgtgtcaaaggcatccccaatccatgccccacaggaagcctgtgccacagccaaaccccacttgcagtgtgaagtcaacctggtgcctccggtcatcctgaccagtgctaaaaacactgtgttcagtgatgtgcctttactaactggacagaaaatacttccaaagcatttgcagggaggaaaatttccccccaaaaaataa

SEQ ID NO: 185267 - DNA, 4920 bp, Homo sapiens
  Payload ID: 16486
  Gene Symbol: SPATA31D3
  Gene Name: SPATA31 subfamily D, member 3
  Uniprot ID: P0C874
  ENST ID: ENST00000334208
  CDS Start-End: 87-2840
acgctctgtgatgcaggcctgtgcttacagttaagcctgggcaccctcagtgctcagttgcttcaggcagctgagctattcagaccatggagaatatcctctgttttctgaacagctatactgagacagggctgagccctgactcacattgtttggatattgacctcaacttcatctgcttgagtgggttggggttgtttatactgtacttgttctacatggtattgaccctgtattcatcacccaccgaaaaaaataatgacacccaaaagcatcagggcagagccaggaggaaaagaaaaagcgtgacatttaaagaccggaaaagtttgcagaaggaagcagaagaggaaagaaagctacattcttttctgaaaagctttggacctcctgtttcctgcagtcccctgggccagcatcatgataccaccctctttcgtcgactgttatgcccagaccctgtctgtcgggtgtgtaacagagcaactgctgatatccagcgactgctgtcttgggagtccctgaaagatgctgctccctctgtgtcccctttggcttcttcagcttctggggctgagtcatcgttcactctggcttccaccccctcagcaaccactccagaagacctaatattgtcctctcggcctaagccctctccaccaccccccttaattctctcacctgacctgatcaccaccttagctgacttattttcaccctcaccactgagggaccctctgccaccacagcctgtttctcccttggattccaagttccccatagaccattccccaccccaacagcttccctttccccttctcccaccacatcacattgagagagtggagcccagcctccaacctgaggccagtttgtctctgaacaccatcttttcatttggctccaccctatgccaagatatttcccaggccgtgaatcgcactgattcatgtgctcgtcatcatggaccaccaaccccatctgctttaccaccggaagattgcactgtgactcagtctaaatcaaatctcaccgtcttgaagacttttccggaaatgttatctctaggtggctctggtgggtcatccacctctgccccaacaacgaaaggcattgaccattcatgccctgcatcttcagaattctcctggtggcagcctcatgccaaggactctttttcctctaattttgtgccatctgatttcatggaggagcttcttacccttcattcttctgaggcctctttaggggggcactctgtggccaacatcatacagcctgttaacatctcttttctcagccatgacattccggcactcctggagagacaagtcaaaagaaggggtgatttcctgatgtggaaagaaaatggaaagaaaccaggatcattcccaacacaacttaggccaaactaccaactaaattcctcacggaatatgttaacctcaactgctgttaagcatgacttagcagaatcctttcctttttgggccagtaaaggcaaactagagtggcagcacatccatcagcagcccccatattctaagtgttttgaggaccatttagagcaaaaatatgtccagctcttctggggtctcccatctttgcacagcgagtctctgcatcctactgtttttgtccaacatggccgttcctccatgtttgtattcttcaatggcattacaaatacatctatgtcccatgaatccccagtacttccccctccccaacctctgttcttgcctagtacccaacctctacccttgcctcaaaccctgccccgaggtcagtccctacatctcactcaggtgaagtccctggctcaacctcaatctccattcccagccctaccacctagtcctctattcctgattagggtgtgtggcgtgtgttttcatagaccccagaatgaggcacggtctcttatgccatctgaaattaatcatctggagtggaacgtgttgcagaaagtgcaggaaagtgtgtggggtttaccctctgtggttcaaaaatcccaggaagacttttgtcctccagctcccaatcctgtattggtcagaaagtccttcaaggtccatgttcccatctccatcattcctggagattttccactcagctctgaggtaaggaagaaactagagcaacacattcgaaagaggctcatccagcgcagatggggcctgccccgcagaatccatgagtctctgtcattgctacgtcctcagaacaaaatttcagagctatctgtgtcagagagcattcatggtccattaaatatctctttggttgagggtcagaggtgcaatgttctaaagaagtccgcatcaagcttccctagaagcttccacgagaggagctcaaatatgctttccatggagaatgtggggaattatcagggatgcagccaggagactgccccaaaaaaccatctcttgcatgatccggagacatcttcagaggaggatctgaggtctaactctgagagagacctaggaactcatatgatgcatctgtcagggaatgattcaggggtgagactaggtcagaaacaacttgaaaatgccctgacagtacatttgagcaagaaatttgaggaaatcaatgagggtcgaatgcctgggactgtgcatagttcatggcactcagtcaagcagacaatatgtcttcctgagaaatcccacagccaaattaaacatcgaaatttggcagcattggtgagtgaggaccaccgcgttgatacctcccaggagatgtccttccttagttccaacaaacaaaagatgttggaagcccatattaaatctttccatatgaagcccatattaaatctttccatatgaggatgctgtggggccttccccgcaagatccgtgaacccacagaaatcttcaaatcagaagaggatatttccaattccttttcccatttctaccttccctcctcagccagctttatttctcagggagattccaaagatggggtctctaagtcttgtagacgaagcacttttcaaggagaaaagttgggaacaacaagctcagtccctgtccttaatcatcctcagcctgtctcctcacctattggcaaagaagggcaggggaccctgagaagacaattttctgatactgaccatgaccttatagagacagatgccaaagatggtgcctccacgccccttagaagaggcactacatattttcaaggagaaaaattagaaacaacaagctcattctccatcttgggtcatcctcacctcgtcacctcacctgttgatcaagaaaagcaggggaccctcagaagagaattcgctgatactgacgaggatcttacagaaagtgtctggacaactgaggatggcagacagacttttctgccccccacacacagcatcatagacgaagtcagtcagaaacagactgtacttgccagtagatgcagtgcagagctgcccatactgcaagctggagttggccgtgattcaagggataagagagagagtgccagtaataatgttaacaggcttcagggcagtagaaagacctttcctgtcaccaatgggtcgaaggagatgttcaaggaagaggagatctgtactcttcaatcacaaactaggaacaacttgacaaccagcaagtcaggaagctgcttagtgacaaacgtgaaaagaagcacttctcatgaaactgaaattttcccaccaagaatatcagttcctcaaactcctaaatcatcatatcttaaaaatcagatgttgagccagttaaagttggtccagaggaagcatagccaacctcagagccatttcactggcatgtctcttgccttagataacttgagttccaaggacttactgactcatgcccagggcatctcgaatcaggacttgggaacttcccaggtgctgcatgtccacttggaggtcagaggaatccgtgtggcacagcagcaggagcccagggtccctacgcatgtcttacagaaatgccaagttaagaatttttcaccagctacaaagagagtgagccctctaagacctaatggaggagagcttggtggaggggatgcagggctggggacatcccaactcaggagaaagagcctccctgttcataacaagacatcaggggaggtgcttgggagcaaatcttccccaaccttgaaaacacagcctcctcctgaaaaccttttcagaaaatggatgaagacctctttgcagtggtttaataaacccagcatatcatatgaagaacaagaaagttcctgggaaaagggtagctccctgtcatcatgtgtgcagaatattggtcgagttataagagctgcctttactgggactactgaagctcagaaaattaggaaagacactagggagttcctagaagagaagctggggcataggcatgggatagatatcacctgtccccaagagcccctttccttcccagtggggcttgggaaagctcagcacaacccagaagtgcatgtcagagcagagcctgtccagggctgtccctgcaactacagggctccctcctgcaaagtgacacgtaccaaatcttgcagccaacaagctatctttgttggccagaattatcctacaaggattagacagatcatagacaaggacagacagccccagaaagttgaggcatttaaggggaagatactgtgtcaaagccatccccaatccatgccccacaggaagcctgtgccacatccaaaccccacttgccggcgtcaggtcagcctggtgtgtccagccgtcccaaccagtgctaaaagccctgtgtttagtgatgtgcctttcctaactggacagaaaatgcttccaaagcatttacagggaggaaaatttccccccacaaaataattcactccttgttgagaatcttgattctccccaataaatgttccaataag

SEQ ID NO: 185268 - DNA, 4787 bp, Homo sapiens
  Payload ID: 16487
  Gene Symbol: SPATA31D4
  Gene Name: SPATA31 subfamily D, member 4
  ENST ID: ENST00000419782
  CDS Start-End: 1-2754
atggagaatatcctctgttttctgaacagctatactgagacagggctgagccctgactcacattgtttggatattgacctcaacttcatctgcttgagtgggttggggttgtttatactgtacttgttctacatggtattgaccctgtattcatcacccaccgaaaaaaataatgacacccaaaagcatcagggcagagccaggaggaaaagaaaaagcgtgacatttaaagaccggaaaagtttgcagaaggaagcagaagaggaaagaaagctacattcttttctgaaaagctttggacctcctgtttcctgcagtcccctgggccagcatcatgataccaccctctttcgtcgactgttatgcccagaccctgtctgtcgggtgtgtaacagagcaactgctgatatccagcgactgctgtcttgggagtccctgaaagatgctgctccctctgtgtcccctttggcttcttcagcttctggggctgagtcatcgttcactctggcttccaccccctcagcaaccactccagaagacctaatattgtcctctcggcctaagccctctccaccaccccccttaattctctcacctgacctgatcaccaccttagctgacttattttcaccctcaccactgagggaccctctgccaccacagcctgtttctcccttggattccaagttccccatagaccattccccaccccaacagcttccctttccccttctcccaccacatcacattgagagagtggagcccagcctccaacctgaggccagtttgtctctgaacaccatcttttcatttggctccaccctatgccaagatatttcccaggccgtgaatcgcactgattcatgtgctcgtcatcatggaccaccaaccccatctgctttaccaccggaagattgcactgtgactcagtctaaatcaaatctcaccgtcttgaagacttttccggaaatgttatctctaggtggctctggtgggtcatccacctctgccccaacaacgaaaggcattgaccattcatgccctgcatcttcagaattctcctggtggcagcctcatgccaaggactctttttcctctaattttgtgccatctgatttcatggaggagcttcttacccttcattcttctgaggcctctttaggggggcactctgtggccaacatcatacagcctgttaacatctcttttctcagccatgacattccggcactcctggagagacaagtcaaaagaaggggtgatttcctgatgtggaaagaaaatggaaagaaaccaggatcattcccaacacaacttaggccaaactaccaactaaattcctcacggaatatgttaacctcaactgctgttaagcatgacttagcagaatcctttcctttttgggccagtaaaggcaaactagagtggcagcacatccatcagcagcccccatattctaagtgttttgaggaccatttagagcaaaaatatgtccagctcttctggggtctcccatctttgcacagcgagtctctgcatcctactgtttttgtccaacatggccgttcctccatgtttgtattcttcaatggcattacaaatacatctatgtcccatgaatccccagtacttccccctccccaacctctgttcttgcctagtacccaacctctacccttgcctcaaaccctgccccgaggtcagtccctacatctcactcaggtgaagtccctggctcaacctcaatctccattcccagccctaccacctagtcctctattcctgattagggtgtgtggcgtgtgttttcatagaccccagaatgaggcacggtctcttatgccatctgaaattaatcatctggagtggaacgtgttgcagaaagtgcaggaaagtgtgtggggtttaccctctgtggttcaaaaatcccaggaagacttttgtcctccagctcccaatcctgtattggtcagaaagtccttcaaggtccatgttcccatctccatcattcctggagattttccactcagctctgaggtaaggaagaaactagagcaacacattcgaaagaggctcatccagcgcagatggggcctgccccgcagaatccatgagtctctgtcattgctacgtcctcagaacaaaatttcagagctatctgtgtcagagagcattcatggtccattaaatatctctttggttgagggtcagaggtgcaatgttctaaagaagtccgcatcaagcttccctagaagcttccacgagaggagctcaaatatgctttccatggagaatgtggggaattatcagggatgcagccaggagactgccccaaaaaaccatctcttgcatgatccggagacatcttcagacgaggatctgaggtctaactctgagagagacctaggaactcatatgatgcatctgtcagggaatgattcaggggtgagactaggtcagaaacaacttgaaaatgccctgacagtacatttgagcaagaaatttgaggaaatcaatgagggtcgaatgcctgggactgtgcatagttcatggcactcagtcaagcagacaatatgtcttcctgagaaatcccacagccaaattaaacatcgaaatttggcagcattggtgagtgaggaccacggcgttgatacctcccaggagatgtccttccttagttccaacaaacaaaagatgttggaagcccatattaaatctttccatatgaagcccatattaaatctttccatatgaggatgctgtggggccttccccgcaagatccgtgaacccatagaaatcttcaaatcagaagaggatatttccaattccttttcccatttctaccttccctcctcagccagctttatttctcagggagattccaaagatggggtctctaagtctcatagacgaagcacttttcaaggagaaaagttgggaacaacaagctcagtccctgtccttaatcatcctcagcctgtctcctcacctattggcaaagaagggcaggggaccctgagaagacaattttctgatactgaccatgaccttatagagacagatgccaaagatggtgcctccacgccccttagaagaggcactacatattttcaaggagaaaaattagaaacaacaagctcattctccatcttgggtcatcctcacctcgtcacctcacctgttgatcaagaaaagcaggggaccctcagaagagaattcgctgatactgacgaggatcttacagaaagtgtctggacaactgaggatggcagacagacttttctgccccccacacacagcatcatagacgaagtcagtcagaaacagactgtacttgccagtagatgcagtgcagagctgcccatactgcaagctggagttggccgtgattcaagggataagagagagagtgccagtaataatgttaacaggcttcagggcagtagaaagacctttcctgtcaccaatgggtcgaaggagatgttcaaggaagaggagatctgtactcttcaatcacaaactaggaacaacttgacaaccagcaagtcaggaagctgcttagtgacaaacgtgaaaagaagcacttctcatgaaactgaaattttcccaccaagaatatcagttcctcaaactcctaaatcatcatatcttaaaaatcagatgttgagccagttaaagttggtccagaggaagcatagccaacctcagagccatttcactggcatgtctcttgccttagataacttgagttccaaggacttactgactcatgcccagggcatctcgaatcaggacttgggaacttcccaggtgctgcatgtccacttggaggtcagaggaatccgtgtggcacagcagcaggagcacagggtccctacgcatgtcttacagaaatgccaagttaagaatttttcaccagctacaaagagagtgagccctttaagacccaatggaggagagcttggtggaggggatgcagggttggggacatcccaactcactagaaagagcctccctgttcataacaaggcatcaggagaggtgcctgggagcaaatcttccccaaccttgaaaacacagcctccttctgaaaaccttttcagaaaatggatgcagaccttattgcagtggtttaataaacctagcataatgtgtgaagaacaagaaagttcttgggaaaagggtagctccctgtcatcatctgtgcagaatagaagtcgagttacaagtagagctgcttttactggtgctactgaagctcagaaaattaggaaagacactggggagttcctagaagaaaagctggggcatagccatgggatagatatcacctgtccctaagaacccttttccttcccagtggagcttgggaaagctcagcacaacccagaagtgcaggtcagagcagagcccttccagggctatccccgcaactacacagctccctcccgcaaagtgacatgtaccaaatcttgcagccaacaagctatctttgttggacagaattatcctacaaggattagacagatcatagacaaggacagacagccccaggaagttgaggcatttaaggggaagatattgtatcaaaggcatccccaatccatgccccacagggatcctgtgccacatctaaaccccacttgtcagcgtcaagtcaccctggtgtgtccagctgtcccaattagtggcaaaagcactgtgttcagtgatgtgcctttactaactggacacaaaatgcattggaagtatttgcagggaggcaaatctccccccacaaaataa

SEQ ID NO: 185269 - DNA, 4478 bp, Homo sapiens
  Payload ID: 16488
  Gene Symbol: SPATA31E1
  Gene Name: SPATA31 subfamily E, member 1
  Uniprot ID: Q6ZUB1
  ENST ID: ENST00000325643
  CDS Start-End: 67-4404
gatacaagcctgggccccagtccctagtcccaaaggggatgcccagagctcagttgcttgaaggcgatgggaaatctcgtcatccctctagggaagggcagggcaggcagggttgagagtgggcagaggattccacccccagctcccagaccatctgtggagtgcacaggagacgacattgcacttcagatggagaaaatgctctttcctctgaagagccctagtgccacatggctgagccctagctccactccctggatgatggatttcatcctcaccagtgtgtgtggcctagtgctcctcttcctattgctcctctacgtccacagtgacccaccctcacccccgcccgggaggaagaggagcagcagggagcctcaaagggagagaagcgggaggtccaggagcaggaagatctcagctctgaaagcttgcagaatcctcctgagggagctggaggagactcgggacctgaactaccttctggaaagccacctgaggaagctcgctggcgaaggcagctcccacctgcccttaggtggagaccccctgggggacgtgtgtaaaccagtgcctgctaaggcccaccagccgcatgggaaatgcatgcaagatccgtctcctgccagcttgtccccaccagctcccccagctcctctggcctccaccctgtcaccaggcccgatgaccttctcagagccttttggaccacactcaaccctgagtgcctccgggccaccagagcccttgcttcccctaaaatgccctgcaacccagccacatgtggtttttcctccttcaccacagccgcatggtcccctggcctcctctccacctccacccgactccagcctggctggacttcagtgtggctccacaacatgccccgtcccccagagctcccctctacacaaccaggtgctgcctcctccaaccagggtgatctctggcctggggtgctccagcgatcccatctgggacctctattgctggagggaggctgccaccacctggggcctctccacctactcacatggcaaatcccagccacggcatcttcccgaccacacctcagaggcttccttctggggagaccccacacccaagcacatggaggtaggtggctgcacattcatccaccctgacgtgcagaagctgctggagaccctcatcgccaagagagcactgatgaagatgtggcaggagaaagaaagaaaacgggccgaccacccgcacatgacatcactggggaaggagtgggacatcacgaccctaaatcccttctggaacgtgtcaacccagccacagcagctgccccgtcctcagcaagtctctgatgccacaaccgtggggaaccacttacagcagaaacgcagccagcttttctgggacctcccctctctcaatagcgagtccctggcgaccacagtctgggtttctaggaacccttcctcacagaatgcacactctgtaccactggataaagcctccacttctcttccaggtgaacctgaggttgaggcatcctcacagctttcccaggcaccgccccagccccaccacatggcccagccccaacatttcactccagcctggccccagtcccagcccccacctttggctgagatccagacccaggcccacctctcaccccctgtcccaagcctggggtgctcttctccaccccagattaggggctgtggggcatcttaccctacatcccaggagaggacacagtctgtcatccccactggaaaggagtatcttgaatggcccttgaagaagcgaccaaagtggaagagggttttgccctctctcctcaaaaagtctcaggctgttctgagccagcccactgcccaccttccccaagagaggccggcctcctggagccccaagtcagcccccatccttcccggggttgtcaccagccctgagctcccagagcactggtggcaaggaaggaatgccatccaccaggagcagtcctgtggccctcccagcagattgcaggcatctggggacctgctacagcctgatggggaattcccagggaggccccagagtcaggcagaagacacgcagcaggccctcttgccctcccagccttctgactttgcagggaagggcaggaaggatgtgcagaagaccgggttcaggagctccggaaggttctctgacaaggggtgcttagggtccaaactagggccggacccaagccgggatcaaggctcaggaaggacctcagtgaaggctctggacgaagacaaggaggcagaaggtgacttacggaggtcctggaagtaccaatcagtaagttccacacccagggacccagacaaggagcatctggaaaacaagctgcaaatccatctggccaggaaggtaggggagatcaaagagggctggatccccatgcctgtgcgtcgctcctggctcatggccaaatgtgctgttcccaagtctgacacccacaggaaacctgggaagctggcatcctggaggggtgggaaagcccacgtgaacacctcccaggagctttccttcctccatccctgcacccagcagatactggaagtacatcttgtaaggttctgtgtgaggcacagctggggtacagacctccagtccctggagcccataaatgtctggtcaggtgaggctcaggccccgcccttcccacaatccacctttaccccctgggcctcctgggtatctcgggttgaatctgtacccaaggttcccattttcctgggaaaacgtcctcagaatggtccaggagacaacagaacaacaagcaagtcagtcccgaccgtgagtggccctctcgctgccccaccgcctgagcaggagggagtccagaggcccccgagagggtcccagtcagctgatacccatgggcgatcagaggcctttccgactggacacaagggcagggggtgttctcagcccccaacatgcagccttgtgggcagaacctggcagagcaggactgtcctggaatccgggaaacccaaacccagactagaggggagtatgggttcagaaatggctgggaacgaggcatggcttgagagtgagagcatgtccccaggagacccctgtagtagcagagccctgcaagtgctcagcatagggtcccagtgggcaagggctgaagatgccctgcaggcactgaaagtgggggagaagcccccaacttgggaagtcaccttgggagccagtgtgagggcaagttcgggaagtgttcaggaggatctgaggagcacaggggctctggggaccactggtaacccctcagcgtcttcagtctgtgttgctcaggatccagagcagctgcacctgaaagcgcaggtggtcagtgagattgcgctcatagtgcaggtggactcagaggagcagctgccaggccgtgccccgggcatcctcctccaggacggcgccacaggcctgtgccttccaggccgccacatggacatgctcactgccgcagacaggctgcccactcaagcccctctgtccacctcccagagtgtgtctggtaagaacatgacagcttcccaggggccatgtgccctcctatggaagggaggggacagtccagggcagcaggagcctgggagcccaaaagcaaaggccccacagaagagtcagaagacgctgggctgtgcggacaagggcgaggcccacaggaggcccagaacaggggagcagggacacaggtccaagggacccaggacctctgaagccagtgggaggagccaccctgcccaagccagggaaataggagacaaacaagaaaggaaatacaaccagcttcagctggagaagggacagacaccaccagaaagccacttccagagaaagatcagtcaccatccacagggtctacaccccaggaaaggaggcacacggtgggaagatgtcctgcagaaaggcaagcctggggcagatgctttccagagctgggggtctggcccaccaaggcagtttatggactgcatggctgacaaagcctggaccatcagcagagttgtgggacaaatcctggtggacaaactggggcttcagtggggacgaggtccctcagaggtcaatcgccacaaaggtgacttccgcgcccaggagaatgtgccttcctgctgccacaggggtcactgccaccaagaacgtagcagagagatgagagctctggcctgcagccctaaagccacccccaagggccaccactgtcctgtcaaaaacaggggcatcagagacagagacagcagttgggccccacctcccagggagcctgtgtccccagctggtccccaccaccacaggccaagaatggcaagcacctcgggcggcccccatccacagctgcaggaactgatgtctgcacagaggtgtcttgcctcctgaactagaccagtcttcttgcatgtctcctgggggagacagggggttctactcaaataaaactgatgcctacacaa

SEQ ID NO: 185270 - DNA, 840 bp, Homo sapiens
  Payload ID: 16489
  Gene Symbol: SPC24
  Gene Name: SPC24, NDC80 kinetochore complex component
  ENST ID: ENST00000423327
  CDS Start-End: 32-436
aaatttgcgcgggttggagcctggcgtagtcatggccgccttccgcgacatagaggaggtgagccaggggctgctcagcctgctgggcgccaaccgcgcggaggcgcagcagcgacggctgctggggcgccacgagcaggtggtggagcggctgctggaaacgcaagacggtgccgagaagcagctgcgagggctgcagacaaggggcatgtttcttgccagtggaggcaagtggaaccaccttctctctgctctccttggggaaggacagaccctagggagcctgcttctctccaccctgcagagatcctcaccatggagaaggaagtggcccagagccttctcaatgcgaaggagcaggtgcaccagggaggcgtggagctgcagcagctggaagctgggcttcaggaggctggggaggaggacacccgtctgaaggccagcctccttcagctcaccagagagctggaagagctcaaggagattgaggcggatctggagcgacaggagaaggaggtcgacgaggacacgacagtcacaatcccctcggccgtgtacgtggctcaactttaccaccaagttagtaaaattgagtgggattatgagtgtgagccagggatggtcaaaggcatccatcatggccccagtgtggcccagcccatccacctggacagcacccagctctccaggaaattcatcagcgactacctctggagtctggtggacaccgagtggtagccaggagcctcgtggctgcgtcttgcacccagcgggcatctgccgtggtcagatccatttcaaatgaaatgtggggacatagatcttttttttttttttttt

SEQ ID NO: 185271 - DNA, 2315 bp, Homo sapiens
  Payload ID: 16489
  Gene Symbol: SPC24
  Gene Name: SPC24, NDC80 kinetochore complex component
  Uniprot ID: Q8NBT2
  ENST ID: ENST00000592540
  CDS Start-End: 33-626
caaatttgcgcgggttggagcctggcgtagtcatggccgccttccgcgacatagaggaggtgagccaggggctgctcagcctgctgggcgccaaccgcgcggaggcgcagcagcgacggctgctggggcgccacgagcaggtggtggagcggctgctggaaacgcaagacggtgccgagaagcagctgcgagagatcctcaccatggagaaggaagtggcccagagccttctcaatgcgaaggagcaggtgcaccagggaggcgtggagctgcagcagctggaagctgggcttcaggaggctggggaggaggacacccgtctgaaggccagcctccttcagctcaccagagagctggaagagctcaaggagattgaggcggatctggagcgacaggagaaggaggtcgacgaggacacgacagtcacaatcccctcggccgtgtacgtggctcaactttaccaccaagttagtaaaattgagtgggattatgagtgtgagccagggatggtcaaaggcatccatcatggccccagtgtggcccagcccatccacctggacagcacccagctctccaggaaattcatcagcgactacctctggagtctggtggacaccgagtggtagccaggagcctcgtggctgcgtcttgcacccagcgggcatctgccgtggtcagatccatttcaaatgaaatgtggggacatagatctttttttttttttttttgagacagagtttcactcttgttgtccagtctggagtgcaatggcacaatctcagctcacagcaacctctgcctcctgggttcaagcgattctcctgcctcagcctccaaagtagctgggattacaggcatgcgccaccacacccagctaattttttgtatttggtagagatggagtttcaccatggtggtcaggctggtcttgaactcctgacctcaggtgatccacccgcccgccttggcctcccaaagtgctaggattccaggcgtgagccatcgtgcccagctagacgtcttccttttttttttttttttgagacggagtctcactctgtcgcccaggctggagtgcagtggtgcgatctcagctcactgcaagctccgcctcctcccgggttcacgccattctcctgcctcagcctcctgagtagctgggactacaggcacctgccaccatgcgcagctaattttttgtatttttagtagagacggggtttcaccatgttagacaggatggtctccatctcctgagtttgtgatctgcccgccttggcctcccaaagtgctgggattacaggtgtgagtcaccgcgcctggccttttttttttttttttttactggatttctttttctcctgattttcggcctcagctcctagagtggcctcagctaggtaaccaacgggagtcgacttatctatgccaggcctgcagtttcacatctgtgacgggatgggacaaatgacaccgtggtattcgatgacagctcccaggtacttcaaggttggcccttactcattcagggggtatgtttgagtgccacggtgtgcccagactctgctaggcaccagagagacaagatacgagtgacatggttctcctcccactgctgacggaggaattaacacaaaagcagacaacactctagaactggagagaggtccagattgcgacaggagccacaccagagtgtgcaggcttcatggaggacagaagcgacttttgtgccgggacttaaaaagataaggaggccaggtgtggtggctcatgcctgcaatcccagcactgtagaaggcagaggccggcagatcacttgagcccaggagttggagaccagactggggaacatggcaagaccccatctctacaaaaaaattaaaaaatttggcctggtgtggtggctcatgcctgtgatcctagcactttgggagttaaaatacaacacttcccagctgcccttatagttaaggtctggccagtgaaatgtatgtggaaatgttacatgacacttctagaaggattcttaaaagacaaatacaccctttcttcccccttcctatttcctggaatgtgggtgtgatggctggagccctggcagccatactgccacgtgtacagacgagtgccgtcctttagggatgacaggagcctggttccctgatgatggcagagccagatatcagcacaaacttatttaaatgggagagagaaggggagaaccaatctcaacttctaccttgtgtaagctgctggttttgggggttttctatgacagataccaaaataaaccctaactgaacatgtactcc

SEQ ID NO: 185272 - DNA, 699 bp, Homo sapiens
  Payload ID: 16489
  Gene Symbol: SPC24
  Gene Name: SPC24, NDC80 kinetochore complex component
  ENST ID: ENST00000585486
  CDS Start-End: 1-506
ccttccgcgacatagaggaggtgagccaggggctgctcagcctgctgggcgccaaccgcgcggaggcgcagcagcgacggctgctggggcgccacgagcaggtggtggagcggctgctggaaacgcaagacggtgccgagaagcagctgcgagagatcctcaccatggagaaggaagtggcccagagccttctcaatgcgaaggagcaggtgcaccagggaggcgtggagctgcagcagctggaagctgggcttcaggaggctggggaggaggacacccgtctgaaggccagcctccttcagctcaccagagagctggaagagctcaaggagattgaggcggatctggagcgacaggagaaggaggtcgacgaggacacgacagtcacaatcccctcggccgtgtacgtggctcaactttaccaccaagttagtaaaattgagtgggattatgagtgtgagccagggatggtcaaaggcagtatcctttttggggagccattttaacccttgtgcactgtaggtagggacataaaatggtgcatagcaggaccctgtaaaaattagccgggtgtggtggcgtgcatctgttgtcccagctacctgggaggctgaggtgggaggatcacttgaggccaggagtttgagaccagcctgggtatcagtgagaccccacgtctataataaatatagtaaagta

SEQ ID NO: 185273 - DNA, 833 bp, Homo sapiens
  Payload ID: 16489
  Gene Symbol: SPC24
  Gene Name: SPC24, NDC80 kinetochore complex component
  ENST ID: ENST00000592967
  CDS Start-End: 1-517
ccgcgacatagaggaggtgagccaggggctgctcagcctgctgggcgccaaccgcgcggaggcgcagcagcgacggctgctggggcgccacgagcaggtggtggagcggctgctggaaacgcaagacggtgccgagaagcagctgcgagagatcctcaccatggagaaggaagtggcccagagccttctcaatgcgaaggagcaggtgcaccagggaggcgtggagctgcagcagctggaagctgggcttcaggaggctggggaggaggacacccgtctgaaggccagcctccttcagctcaccagagagctggaagagctcaaggagattgaggcggatctggagcgacaggagaaggaggtcgacgaggacacgacagtcacaatcccctcggccgtgtacgtggctcaactttaccaccaactcctagagtggcctcagctaggtaaccaacgggagtcgacttatctatgccaggcctgcagtttcacatctgtgacgggatgggacaaatgacaccgtggtattcgatgacagctcccaggtacttcaaggttggcccttactcattcagggggtatgtttgagtgccacggtgtgcccagactctgctaggcaccagagagacaagatacgagtgacatggttctcctcccactgctgacggaggaattaacacaaaagcagacaacactctagaactggagagaggtccagattgcgacaggagccacaccagagtgtgcaggcttcatggaggacagaagcgacttttgtgccgggacttaaaaagataaggaggccaggtgtggtggctcatgcctgcaatccc

SEQ ID NO: 185274 - DNA, 832 bp, Homo sapiens
  Payload ID: 16489
  Gene Symbol: SPC24
  Gene Name: SPC24, NDC80 kinetochore complex component
  ENST ID: ENST00000591396
  CDS Start-End: 1-516
cgcgacatagaggaggtgagccaggggctgctcagcctgctgggcgccaaccgcgcggaggcgcagcagcgacggctgctggggcgccacgagcaggtggtggagcggctgctggaaacgcaagacggtgccgagaagcagctgcgagagatcctcaccatggagaaggaagtggcccagagccttctcaatgcgaaggagcaggtgcaccagggaggcgtggagctgcagcagctggaagctgggcttcaggaggctggggaggaggacacccgtctgaaggccagcctccttcagctcaccagagagctggaagagctcaaggagattgaggcggatctggagcgacaggagaaggaggtcgacgaggacacgacagtcacaatcccctcggccgtgtacgtggctcaactttaccaccaagttagtaaaattgagtgggattatgagtgtgagccagggatggtcaaaggcaggggtatgtttgagtgccacggtgtgcccagactctgctaggcaccagagagacaagatacgagtgacatggttctcctcccactgctgacggaggaattaacacaaaagcagacaacactctagaactggagagaggtccagattgcgacaggagccacaccagagtgtgcaggcttcatggaggacagaagcgacttttgtgccgggacttaaaaagataaggaggccaggtgtggtggctcatgcctgcaatcccagcactgtagaaggcagaggccggcagatcacttgagcccaggagttggagaccagactggggaacatggcaagaccccatctctacaaaaaaattaaa

SEQ ID NO: 185275 - DNA, 378 bp, Homo sapiens
  Payload ID: 16489
  Gene Symbol: SPC24
  Gene Name: SPC24, NDC80 kinetochore complex component
  ENST ID: ENST00000586708
  CDS Start-End: 1-378
gacatagaggaggtgagccaggggctgctcagcctgctgggcgccaaccgcgcggaggcgcagcagcgacggctgctggggcgccacgagcaggtggtggagcggctgctggaaacgcaagacggtgccgagaagcagctgcgaggtacgtggctcaactttaccaccaagttagtaaaattgagtgggattatgagtgtgagccagggatggtcaaaggcatccatcatggccccagtgtggcccagcccatccacctggacagcacccagctctccaggaaattcatcagcgactacctctggagtctggtggacaccgagtggtagccaggagcctcgtggctgcgtcttgcacccagcgggcatctgccgtggt

SEQ ID NO: 185276 - DNA, 633 bp, Homo sapiens
  Payload ID: 16489
  Gene Symbol: SPC24
  Gene Name: SPC24, NDC80 kinetochore complex component
  ENST ID: ENST00000585567
  CDS Start-End: 7-633
gtagtcatggccgccttccgcgacatagaggaggtgagccaggggctgctcagcctgctgggcgccaaccgcgcggaggcgcagcagcgacggctgctggggcgccacgagcaggtggtggagcggctgctggaaacgcaagacggtgccgagaagcagctgcgagagatcctcaccatggagaaggaagtggcccagagccttctcaatgcgaaggagcaggtgcaccagggaggcgtggagctgcagcagctggaagctgggcttcaggaggctggggaggaggacacccgtctgaaggccagcctccttcagctcaccagagagctggaagagctcaaggagattgaggcggatctggagcgacaggagaaggaggtcgacgaggacacgacagtcacaatcccctcggccgtgtacgtggctcaactttaccaccaagtgatccgcccaccttggcctcccaaagtgctggactcaagagatcttcccacctcagcctccaagtatctgggactacaggtgtgcgccatcgcatccggctggattgtgtcacggtggagagaaactcaaaacttcctggagagaaatggaggtgtcatcctggtccccccgggcctgtttctcttatcc

SEQ ID NO: 185277 - DNA, 1354 bp, Homo sapiens
  Payload ID: 16490
  Gene Symbol: SPC25
  Gene Name: SPC25, NDC80 kinetochore complex component
  Uniprot ID: Q9HBM1
  ENST ID: ENST00000282074
  CDS Start-End: 143-817
aagtgcactaggtttgaaatcggaaagttggcggggctgcgggagctgagcctagagtccggctgttggctagagtgggcgcggatctggtgtggggaaggcggcgggactcaggcctgcctgcgaagcattgtcctacataatggtagaggacgaactggcacttttcgataaaagcataaatgaattttggaataaattcaaaagtacggacacctcctgtcagatggcgggactaagagatacctacaaggattccatcaaagcatttgcagaaaagctgtctgtgaaattaaaggaagaagaacgaatggttgagatgtttctggaatatcaaaatcagatcagcaggcaaaataagctcattcaagaaaaaaaggataacttgttaaaattgattgctgaagtaaaaggcaaaaagcaggaattggaagtactgactgcaaatatccaggatcttaaggaagaatattctaggaagaaggaaactatttctactgctaataaagcgaatgcagagaggttgaaaaggctgcagaaatctgcagacttgtataaagatcgacttggactagaaattcgaaaaatttatggtgagaaattgcagtttattttcactaatattgaccctaagaatcctgagagcccatttatgttttccttacatctcaatgaagcaagggactatgaagtgtcagatagtgcccctcatcttgagggcctagcagaatttcaagagaatgtaaggaagaccaacaatttttcagcttttcttgccaatgttcggaaagcttttactgccacggtttataattaacatacaaatagtgtatataaaaacggtttatttttcttctctattacatatctctttttttcttgtttttattattattatactttaagttttagggtacatgtgcacaatgtgcaggtttgttacatatgtatacatgtgccatattggtgtgctgcacccattaactcgtcatttcattaggtatatctcctaatgctatccctcccccctcccccaacccacaacagtccccgttgtgtgatgttccccttcctgtgtccatgtgttctcattgttcaattcccacctaggagtgagaatatgtggtgtttggttttttgtcctttcgatagtttgctgagaatgatggtttccagcttcatccatgttcctacaaaggacatgaactcatccttttttatggctgcatagtattccatggtgtatatgtgccacattttcttaatccagtctatcattgttggacatttgggttggttccaagtctttgctattgtgaatagtgccgaaataaacatacgtgtgcatgtgtct

SEQ ID NO: 185278 - DNA, 596 bp, Homo sapiens
  Payload ID: 16490
  Gene Symbol: SPC25
  Gene Name: SPC25, NDC80 kinetochore complex component
  ENST ID: ENST00000451987
  CDS Start-End: 251-596
agacaaagcctgaatcctggaaaaagccaactctttgaacaggaattagagtgtgatcggctcagttgacgtacagggaaacctttatttgaagccgataaatgacttgtcgtgggcgagcccttcgggtgctattaatactttcgggtcacagcggagactctggctgttgttcagaaaagaactacgaatcccagaatgccctgttcccccattttcccctcgagaatccaaggcattgtcctacataatggtagaggacgaactggcacttttcgataaaagcataaatgaattttggaataaattcaaaagtacggacacctcctgtcagatggcgggactaagagatacctacaaggattccatcaaagcatttgcagaaaagctgtctgtgaaattaaaggaagaagaacgaatggttgagatgtttctggaatatcaaaatcagatcagcaggcaaaataagctcattcaagaaaaaaaggataacttgttaaaattgattgctgaagtaaaaggcaaaaagcaggaattggaagtactgactgcaaatatccaggatcttaaggaagaatattctaggaagaaggaaa

SEQ ID NO: 185279 - DNA, 596 bp, Homo sapiens; identical to SEQ ID NO: 185278
  Payload ID: 16490
  Gene Symbol: SPC25
  Gene Name: SPC25, NDC80 kinetochore complex component
  ENST ID: ENST00000612416
  CDS Start-End: 251-596

SEQ ID NO: 185280 - DNA, 675 bp, Homo sapiens
  Payload ID: 16490
  Gene Symbol: SPC25
  Gene Name: SPC25, NDC80 kinetochore complex component
  Uniprot ID: Q9HBM1
  ENST ID: ENST00000611144
  CDS Start-End: 1-675
atggtagaggacgaactggcacttttcgataaaagcataaatgaattttggaataaattcaaaagtacggacacctcctgtcagatggcgggactaagagatacctacaaggattccatcaaagcatttgcagaaaagctgtctgtgaaattaaaggaagaagaacgaatggttgagatgtttctggaatatcaaaatcagatcagcaggcaaaataagctcattcaagaaaaaaaggataacttgttaaaattgattgctgaagtaaaaggcaaaaagcaggaattggaagtactgactgcaaatatccaggatcttaaggaagaatattctaggaagaaggaaactatttctactgctaataaagcgaatgcagagaggttgaaaaggctgcagaaatctgcagacttgtataaagatcgacttggactagaaattcgaaaaatttatggtgagaaattgcagtttattttcactaatattgaccctaagaatcctgagagcccatttatgttttccttacatctcaatgaagcaagggactatgaagtgtcagatagtgcccctcatcttgagggcctagcagaatttcaagagaatgtaaggaagaccaacaatttttcagcttttcttgccaatgttcggaaagcttttactgccacggtttataattaa

SEQ ID NO: 185281 - DNA, 1344 bp, Homo sapiens
  Payload ID: 16490
  Gene Symbol: SPC25
  Gene Name: SPC25, NDC80 kinetochore complex component
  Uniprot ID: Q9HBM1
  ENST ID: ENST00000616584
  CDS Start-End: 132-806
gtttgaaatcggaaagttggcggggctgcgggagctgagcctagagtccggctgttggctagagtgggcgcggatctggtgtggggaaggcggcgggactcaggcctgcctgcgaagcattgtcctacataatggtagaggacgaactggcacttttcgataaaagcataaatgaattttggaataaattcaaaagtacggacacctcctgtcagatggcgggactaagagatacctacaaggattccatcaaagcatttgcagaaaagctgtctgtgaaattaaaggaagaagaacgaatggttgagatgtttctggaatatcaaaatcagatcagcaggcaaaataagctcattcaagaaaaaaaggataacttgttaaaattgattgctgaagtaaaaggcaaaaagcaggaattggaagtactgactgcaaatatccaggatcttaaggaagaatattctaggaagaaggaaactatttctactgctaataaagcgaatgcagagaggttgaaaaggctgcagaaatctgcagacttgtataaagatcgacttggactagaaattcgaaaaatttatggtgagaaattgcagtttattttcactaatattgaccctaagaatcctgagagcccatttatgttttccttacatctcaatgaagcaagggactatgaagtgtcagatagtgcccctcatcttgagggcctagcagaatttcaagagaatgtaaggaagaccaacaatttttcagcttttcttgccaatgttcggaaagcttttactgccacggtttataattaacatacaaatagtgtatataaaaacggtttatttttcttctctattacatatctcttttttttcttgtttttattattattatactttaagttttagggtacatgtgcacaatgtgcaggtttgttacatatgtatacatgtgccatattggtgtgctgcacccattaactcgtcatttcattaggtatatctcctaatgctatccctccccgctcccccaacccacaacagtccccgttgtgtgatgttccccttcctgtgtccatgtgttctcattgttcaattcccacctaggagtgagaatatgtggtgtttggttttttgtcctttcgatagtttgctgagaatgatggtttccagcttcatccatgttcctacaaaggacatgaactcatccttttttatggctgcatagtattccatggtgtatatgtgccacattttcttaatccagtctatcattgttggacatttgggttggttccaagtctttgctattgtgaatagtgccgaaataaacatacgtgtgcatgtgtct

SEQ ID NO: 185282 - DNA, 6204 bp, Homo sapiens
  Payload ID: 16491
  Gene Symbol: SPECC1L-ADORA2A
  Gene Name: SPECC1L-ADORA2A readthrough (NMD candidate)
  ENST ID: ENST00000358654
  CDS Start-End: 228-2963
ctcaacgggtctcggctgagccaccgggtgagctcaccgcccagcccaaaccaggagattgcgagggagcgatgcggtgcagcgcgtgttcttggggaagatcccgactaagccattttccagtggcacctcttccatcatgagttcctgaggcagtccgatggggctactttattccagaacaatcacaatttgcttgtaaatgcatcacgaagaggcagcccagaatgaagaaagcaagcaggagtgttggctcagtgcctaaagtgtctgcaataagtaaaacgcaaacagcagaaaaaattaaacctgaaaacagctcttcagcatctacgggaggcaaacttgtaaaacctggaacagcagcatcattgtcaaagaccaagagcagtgatgaccttttagctggaatggccggaggggtaacggtgactaatggtgttaaaggaaagaaaagcacctgcccatctgcagcaccttcagcatctgcccctgccatgaccaccgtggagaacaaatccaagattagcacaggcacagcttcttcaaccaagcggagcacttctacaggtaataaagaatccagttctactagagaaagattacgtgaacgtacccgattaaaccagagcaaaaaactaccttctgcaggtcagggagctaatgacatggcattggccaaacgttcccgcagtcgaactgctacagaatgtgacgttcgtatgagcaagtctaagtcagacaatcagatcagtgacagagctgctttggaggccaaagtgaaggatcttctcacgctggcaaaaaccaaagacgtagaaattttacatttgagaaatgaactgcgagacatgcgtgcccagctgggcattaatgaggatcattctgagggtgatgaaaaatctgagaaggaaactattatggctcaccagccgactgatgtggagtccactttattgcagttgcaggaacagaatactgccatccgtgaagaactcaaccagctgaaaaatgaaaacagaatgttaaaggacaggttgaatgcattgggcttttccctagagcagaggttagacaattctgaaaaactgtttggctatcagtccctgagcccagaaatcacccctggtaaccagagcgatggaggaggaactctgacttcttcagtggaaggctctgcccctggctcagtggaggatctcttgagtcaggatgaaaatacactaatggaccatcagcacagtaactccatggacaatttagacagtgagtgcagtgaggtctaccagcccctcacatcgagcgatgatgcgctggatgcaccatcctcctcagagtcggaaggcatccccagcatagagcgctcccggaaggggagcagcgggaatgccagtgaagtgtccgtggcttgcctgactgaacggatacaccagatggaagagaaccaacacagtacaagtgaggaactccaggcaaccctgcaagagctagctgatttacagcagattacccaggaactgaatagtgaaaacgaaaggcttggagaagagaaggttattctgatggagtctttatgtcagcagagcgataagttggaacactttagtcgacagattgaatacttccgctctcttctagatgagcatcacatttcttatgtcatagatgaagatgtaaaaagtgggcgctatatggaattagagcaacgttacatggacctcgctgagaatgcccgttttgaacgggagcagcttcttggtgtccagcagcatttaagcaatactttgaaaatggcagaacaagacaataaggaagctcaagaaatgataggggcactcaaagaacgcagtcaccatatggagcgaattattgagtctgagcagaaaggaaaagcagccttggcagccacgttagaggaatacaaagccacagtggccagtgaccagatagagatgaatcgcctgaaggctcagctggagaatgaaaagcagaaagtggcagagctgtattctatccataactctggagacaaatctgatattcaggacctcctggagagtgtcaggctggacaaagaaaaagcagagactttggctagtagcttgcaggaagatctggctcatacccgaaatgatgccaatcgattacaggatgccattgctaaggtagaggatgaataccgagccttccaagaagaagctaagaaacaaattgaagatttgaatatgacgttagaaaaattaagatcagacctggatgaaaaagaaacagaaaggagtgacatgaaagaaaccatctttgaacttgaagatgaagtagaacaacatcgtgctgtgaaacttcatgacaacctcattatttctgatctagagaatacagttaaaaaactccaggaccaaaagcacgacatggaaagagaaataaagacactccacagaagacttcgggaagaatctgcggaatggcggcagtttcaggctgatctccagactgcagtagtcattgcaaatgacattaaatctgaagcccaagaggagattggtgatctaaagcgccggttacatgaggctcaagaaaaaaatgagaaactcacaaaagaattggaggaaataaagtcacgcaagcaagaggaggagcgaggccgggtatacaattacatgaatgccgttgagagagatttggcagccttaaggcagggaatgggactgagtagaaggtcctcgacttcctcagagccaactcctacagtaaaaaccctcatcaagtcctttgacagtgcatctcaagtaccaaaccctgctgcagctgcaattcctcgaacgcccctgagcccaagtcctatgaaaacccctcctgcagcagctgtgtcccctatgcagatggagtctagttctgtcgcccacgctggaatgcagtggcgtgaccttggctcactgcaacctctgcctcctgggttcaagtgattctcctgcctcagccccctgagtagctgggactacagagacattccataagtggaccaatctcaacatccaaacccctgacagccctgtcagataagagaccaaactatggggaaatccctgttcaagagcatctgttaagaacatcttcagccagccggcctgcttccctgccaagagtgcctgcgatggaaagtgccaagaccctctcagtgtctcgacgaagtagtgaagaagtgaaacgggacatttctgcacaggagggagcgtcgccagcctctctgatggctatgggaaccacgtctccacagctttccctgtcctcttctccaacggcatctgtgactcccaccacccgaagccgaataagagaagaaaggaaagaccctctctcagcattggccagagaatatggaggatcaaagaggaacgccttgctgaagtggtgtcagaagaaaacagaaggctatcagaatattgacattacaaacttcagcagcagctggaatgatgggctggccttctgtgccctcctgcatacatatctccctgcccacattccatatcaagaactgaacagccaggataagagaaggaacttcatgctggctttccaggcagctgaaagtgtcggcatcaaatccacactggacattaatgaaatggtacggactgaacgacccgactggcagaacgtgatgctgtatgtgacggcgatctacaagtactttgagacctgagcatgccgggaggagccgccccaatagcgggggtacccctccacagcgaccgagcgacaccgacgccattagctacgcacccctgtaaagcttccagcaactctgggctgccccacagcgtgtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgacttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatg

SEQ ID NO: 185283 - DNA, 2736 bp, Homo sapiens
  Payload ID: 16491
  Gene Symbol: SPECC1L-ADORA2A
  Gene Name: SPECC1L-ADORA2A readthrough (NMD candidate)
  Uniprot ID: P29274
  ENST ID: ENST00000610595
  CDS Start-End: 631-1869
gagggcgtgggaggagggaggtgaggcagctccctccgagtggaagctcacagtcagctgcagcgccgcccctgccctgactgcagctgactggcaggggcacctggaggcagcgggttcgggcgcagtatgagagggcttaccctctgcggcagtgggagacaggaccaggcagctccccacatccttccacatccgagctccaggggtctctggcttgtcctttcacagggcggctggtgtcccttaggaaaaaaacagaccacatctgatccttggccctgagtccagagtgggaggcaccgtgacaacaatgcgcagagcagggaatgcagggagccatggatagtgctggggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgacttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatg

SEQ ID NO: 185284 - DNA, 2630 bp, Homo sapiens
  Payload ID: 16491
  Gene Symbol: SPECC1L-ADORA2A
  Gene Name: SPECC1L-ADORA2A readthrough (NMD candidate)
  Uniprot ID: P29274
  ENST ID: ENST00000618076
  CDS Start-End: 525-1763
gagggcgtgggaggagggaggtgaggcagctccctccgagtggaagctcacagtcagctgcagcgccgcccctgccctgactgcagctgactggcaggggcacctggaggcagcgggttcgggcgcagtatgagagggcttaccctctgcggcagtgggagacaggaccaggcagctccccacatccttccacatccgagctccaggggtctctggcttgtcctttcacagggcggctggtgtcccttaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgacttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatg

SEQ ID NO: 185285 - DNA, 2412 bp, Homo sapiens
  Payload ID: 16491
  Gene Symbol: SPECC1L-ADORA2A
  Gene Name: SPECC1L-ADORA2A readthrough (NMD candidate)
  Uniprot ID: P29274
  ENST ID: ENST00000611543
  CDS Start-End: 307-1545
gactcccaggcccgaggactcctggaagggaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgacttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatg

SEQ ID NO: 185286 - DNA, 2965 bp, Homo sapiens
  Payload ID: 16492
  Gene Symbol: SPOP
  Gene Name: speckle-type POZ protein
  Uniprot ID: O43791
  ENST ID: ENST00000347630
  CDS Start-End: 349-1473
ggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagagatttcctgttagacaagacaaattagagttttcctactgacttaacttgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgtactgtgtggtatctctggtcttttgtttcactcacctgccttgtctcttgggtctgagtcccttgcttaagggattttgaagtcctagttttcagcttgcagagattatgtctgaaatgcctaatgagtcgcagggatttgttgagactccgtaatctcaagttctctttgtgagctatcagcatctgccagtctcttgtcctccctgagtatctcacagtccatatcctgatgagggatcaggcccctacctctgccaaggcaagtaatggtagtgggcttttaaactgccccccgtatgttttaagacctaatccccacctcccttcttctaactaaatataaaaagatccaggggacataaatgtggagattaaataaagggaaattattgtctct

SEQ ID NO: 185287 - DNA, 2985 bp, Homo sapiens
  Payload ID: 16492
  Gene Symbol: SPOP
  Gene Name: speckle-type POZ protein
  Uniprot ID: O43791
  ENST ID: ENST00000393328
  CDS Start-End: 367-1491
gtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagatcgagtcttgctctgtcacccaggctggagtgcagtggcgcgatctcagctcactgccacctttgcctcctgggttcaagcgattcttctgcctcagcctcccgagtagctgggattacagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaagaaaggacattgagttttaacagaagggaaaaggaaagaagaaaagatttttgcagaatttctcaaaaatcagtttgtggattccagtagtatttatattgagagaaacaaattttagtccttctaactgtgctaaaacttggatatttgtgaaaactccttaccaccatacaagcatcagaagagctctcttgttgttagcacttattgtttgcaagaacagaatacatccttttatccttttatgaaaaatgacaagtgaaggcaaaaggggaaggttatttgatctggaagatgagtgttctgatgtggtggcttttgcaaaaatctttattggtgttgaaaactggaaaaaataactcatccagaattcatattgtcttgacaagaactatggttctctgtttttagatattgtggaaaatgtttttgggcatttttctctgattttatttcttctcccccacccctttttctaaaaaacaaacaaaaaaaaaaacacacaaaacaaaaacagaacaaaagaagagagaaggaaattttatcaattaaaaatgctgtgtgataaaatcccagcccagattgctcagctgtttgtacctgacttgccgcctgcataggagccagttctgttccttctgactagcccctcttcctccaggggagaacttccaaatgttaatttttttttttttgaaaatataaataattactattttgtactgtgtggtatctctggtcttttgtttcactcacctgccttgtctcttgggtctgagtcccttgcttaagggattttgaagtcctagttttcagcttgcagagattatgtctgaaatgcctaatgagtcgcagggatttgttgagactccgtaatctcaagttctctttgtgagctatcagcatctgccagtctcttgtcctccctgagtatctcacagtccatatcctgatgagggatcaggcccctacctctgccaaggcaagtaatggtagtgggcttttaaactgccccccgtatgttttaagacctaatccccacctcccttcttctaactaaatataaaaagatccaggggacataaatgtggagattaaataaagggaaattattgtctctaa

SEQ ID NO: 185288 - DNA, 1932 bp, Homo sapiens
  Payload ID: 16492
  Gene Symbol: SPOP
  Gene Name: speckle-type POZ protein
  Uniprot ID: O43791
  ENST ID: ENST00000503676
  CDS Start-End: 633-1757
atatagcttaaagcatttaactggaaaggaccttggaaatccttttaaaggaggatgggggtggaaatgcacaggttgcttctctctctctctctctttttttttttttttgagacggtcacccaggctgtagtgcagtggcgtgatctcggctcactgtggcctccacctcccaagtagctgggattacaggcttgcgccatcatgcagggctaatttttgtatttttagtagagacgaggtttcatcatgttggccaggctggtctggaactcctgacctcaagtgatctgcccaccttggcctcccaaagtgctgggattaaaggcatgagccaccacgcctggcctaggttgttcctctactgtgaatcttgaggttatggtttccactagactatagtgctcaactatagtggcctattttaagtggccttataattcctaaccaaagtgacttgtgaaacagaggaccctggataaatttaaatgttataaagatgataaaatgtacagagatttcctgttagacaagacaaattagagttttcctactgacttaacttgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggg

SEQ ID NO: 185289 - DNA, 984 bp, Homo sapiens
  Payload ID: 16492
  Gene Symbol: SPOP
  Gene Name: speckle-type POZ protein
  ENST ID: ENST00000505581
  CDS Start-End: 271-984
ggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagagatttcctgttagacaagacaaattagagttttcctactgacttaacttgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaag

SEQ ID NO: 185290 - DNA, 534 bp, Homo sapiens
  Payload ID: 16492
  Gene Symbol: SPOP
  Gene Name: speckle-type POZ protein
  ENST ID: ENST00000504212
  CDS Start-End: 190-324
cccggatgttgcggacagtatgaggcaagcgcagggggacggggaccagcagctgtcgccgccgctctcaggctctgggaaccacccttctactttctgtctctaggaatttcactactctagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagtgttctcagcagctgaaaaaagttataaaagctattggtcagtgtgagatttcttaaaatgtggatgaggaacataagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgtta

SEQ ID NO: 185291 - DNA, 450 bp, Homo sapiens
  Payload ID: 16492
  Gene Symbol: SPOP
  Gene Name: speckle-type POZ protein
  ENST ID: ENST00000451526
  CDS Start-End: 355-450
gctccgagtgtgtgtgtatttgtgtatcggcggtcccgcaggtcccggatgttgcggacagtatgaggcaagcgcagggggacggggaccagcagctgtcgccgccgctctcagatcgagtcttgctctgtcacccaggctggagtgcagtggcgcgatctcagctcactgccacctttgcctcctgggttcaagcgattcttctgcctcagcctcccgagtagctgggattacaggctctgggaaccacccttctactttctgtctctaggaatttcactactctagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattc

SEQ ID NO: 185292 - DNA, 779 bp, Homo sapiens
  Payload ID: 16492
  Gene Symbol: SPOP
  Gene Name: speckle-type POZ protein
  ENST ID: ENST00000509869
  CDS Start-End: 1-217
aaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgagattcttatcaagagttgaggcctatggtttgtcttgctggagtaattgtgaaataagaagaaggaactacaggtcattaactttgcctctgggcttatgactgcgtttaagggatgacttgcatcttgaaggttaaaagaaatctgggtcattaaggatgttcctaagctgtctttctcatcttactgttaggaacagcaagagtggggagctaattctcaaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaag

SEQ ID NO: 185293 - DNA, 873 bp, Homo sapiens
  Payload ID: 16492
  Gene Symbol: SPOP
  Gene Name: speckle-type POZ protein
  ENST ID: ENST00000514121
  CDS Start-End: 459-873
atgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagatcgagtcttgctctgtcacccaggctggagtgcagtggcgcgatctcagctcactgccacctttgcctcctgggttcaagcgattcttctgcctcagcctcccgagtagctgggattacaggctctgggaaccacccttctactttctgtctctaggaatttcactactctagagatttcctgttagacaagacaaattagagttttcctactgacttaacttgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgta

SEQ ID NO: 185294 - DNA, 773 bp, Homo sapiens
  Payload ID: 16492
  Gene Symbol: SPOP
  Gene Name: speckle-type POZ protein
  ENST ID: ENST00000510476
  CDS Start-End: 574-773
taaagcatttaactggaaaggaccttggaaatccttttaaaggaggatgggggtggaaatgcacaggttgcttctctctctctctctctttttttttttttttgagacggtcacccaggctgtagtgcagtggcgtgatctcggctcactgtggcctccacctcccaagtagctgggattacaggcttgcgccatcatgcagggctaatttttgtatttttagtagagacgaggtttcatcatgttggccaggctggtctggaactcctgacctcaagtgatctgcccaccttggcctcccaaagtgctgggattaaaggcatgagccaccacgcctggcctaggttgttcctctactgtgaatcttgaggttatggtttccactagactatagtgctcaactatagtggcctattttaagtggccttataattcctaaccaaagtgacttgtgaaacagaggaccctggataaatttaaatgttataaagatgataaaatgtacagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatg

SEQ ID NO: 185295 - DNA, 918 bp, Homo sapiens
  Payload ID: 16492
  Gene Symbol: SPOP
  Gene Name: speckle-type POZ protein
  ENST ID: ENST00000506399
  CDS Start-End: 241-375
tgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagtgttctcagcagctgaaaaaagttataaaagctattggtcagtgtgagatttcttaaaatgtggatgaggaacataagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcaca

SEQ ID NO: 185296 - DNA, 1865 bp, Homo sapiens
  Payload ID: 16492
  Gene Symbol: SPOP
  Gene Name: speckle-type POZ protein
  Uniprot ID: O43791
  ENST ID: ENST00000504102
  CDS Start-End: 369-1493
aagataggcggagtcttgagggaggaggagcagggaaacccagggaggggaggggaggagaagggagtaatggggaggaggccgcgcggggtggggtctggcggtacgcgctggctgcgtcgacgtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctggctgagtttgatactgtggggattcagtttaggcgctggcccgaggatatcccagcggtggtacttcggagacacctgtctgcatctgactgagcagaacaaatcgtcaggtgcctggagcaaaaaggaaaaaaaaaaaa

SEQ ID NO: 185297 - DNA, 919 bp, Homo sapiens
  Payload ID: 16492
  Gene Symbol: SPOP
  Gene Name: speckle-type POZ protein
  ENST ID: ENST00000507970
  CDS Start-End: 363-919
agtgtgcgcgctccgagtgtgtgtgtatttgtgtatcggcggtcccgcaggtcccggatgttgcggacagtatgaggcaagcgcagggggacggggaccagcagctgtcgccgccgctctcagatcgagtcttgctctgtcacccaggctggagtgcagtggcgcgatctcagctcactgccacctttgcctcctgggttcaagcgattcttctgcctcagcctcccgagtagctgggattacagagatttcctgttagacaagacaaattagagttttcctactgacttaacttgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggct

SEQ ID NO: 185298 - DNA, 563 bp, Homo sapiens
  Payload ID: 16492
  Gene Symbol: SPOP
  Gene Name: speckle-type POZ protein
  ENST ID: ENST00000515508
  CDS Start-End: 212-563
gtgtatcggcggtcccgcaggtcccggatgttgcggacagtatgaggcaagcgcagggggacggggaccagcagctgtcgccgccgctctcaggctctgggaaccacccttctactttctgtctctaggaatttcactactctagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatgg

SEQ ID NO: 185299 - DNA, 1134 bp, Homo sapiens
  Payload ID: 16492
  Gene Symbol: SPOP
  Gene Name: speckle-type POZ protein
  ENST ID: ENST00000509079
  CDS Start-End: 348-1134
gtgctgacgccatgacgccccggctggtgtgtgtcggtgtgtatgtgtgtgtgtgagtgtgcgcgctccgagtgtgtgtgtatttgtgtatcggcggtcccgcaggtcccggatgttgcggacagtatgaggcaagcgcagggggacggggaccagcagctgtcgccgccgctctcaggctctgggaaccacccttctactttctgtctctaggaatttcactactctagagatttcctgttagacaagacaaattagagttttcctactgacttaacttgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaagg

SEQ ID NO: 185300 - DNA, 428 bp, Homo sapiens
  Payload ID: 16492
  Gene Symbol: SPOP
  Gene Name: speckle-type POZ protein
  ENST ID: ENST00000508805
  CDS Start-End: 308-428
gtcccggatgttgcggacagtatgaggcaagcgcagggggacggggaccagcagctgtcgccgccgctctcagagatttcctgttagacaagacaaattagagttttcctactgacttaacttgaaaagttcttcaggaaggtcgggcatggtgactcatgcctgtaatcccagcactttgggaggctgaggcaggaagattgcttgagctcaggagttcgagaccatcctggtcaacatgggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataact

SEQ ID NO: 185301 - DNA, 6025 bp, Homo sapiens
  Payload ID: 16493
  Gene Symbol: SPOPL
  Gene Name: speckle-type POZ protein-like
  Uniprot ID: Q6IQ16
  ENST ID: ENST00000280098
  CDS Start-End: 380-1558
agtcgtaactcggaagccggagcccagacgggcccgcggcgggggggtgggggctgcgcgggggcgggagtggcggaggtggccgcccctggcggcgggtttgtttatcccggggaagaagtttaggagcgggagatagggaaggagggcgggtcggggaggagggatgcggttcggcggaggcggccgccacagggacttgccgccatcacccctgctgccaccaccgcagcctcgggctcccagggcggacacggccaccgcctcagcgggagaggagtctccaccaggactgaccgctgccgcccagcacgtccaggtaaggtactcaactgtgtggggtactacataaatcctgaaagactacaataaagtggtgatgtctcgggaacccaccccacctctacctggagatatgtctactggtcccatagcagaaagctggtgttacacacaggttaaagtagtaaaattttcctatatgtggaccattaataacttcagtttttgtcgagaggaaatgggtgaagtgttaaaaagttcaacattttcatctggcccaagtgacaaaatgaaatggtgcctgagggtaaacccaaagggattagatgatgaaagtaaagactacttgtccttatatttgcttttagtcagctgccccaaaagtgaagttcgagcaaaattcaaattttcccttctgaatgctaaaagggaagaaacaaaagcaatggaaagccaaagagcatatcgatttgtgcaagggaaggactggggttttaaaaaattcattagaagggactttttgcttgatgaagctaatggtcttttaccagatgacaagcttacattattttgtgaggtgagtgtggtccaagattcagtaaacatatcaggacatactaatacaaatactttgaaggtgcctgagtgtcgtctagcagaagatttaggtaatctctgggaaaacacaagatttacagactgcagttttttcgtgagaggacaagaatttaaagctcataaatctgtgcttgcagctcgatctccagtttttaacgccatgtttgaacatgaaatggaagaaagcaaaaagaatcgagtggaaataaatgatttagaccctgaagtttttaaagaaatgatgagattcatttacacagggagagcaccaaaccttgacaaaatggctgacaacttgttggcagctgcagacaaatatgcactggaacggctgaaggtcatgtgcgaagaagctttgtgtagtaacctctcagtagagaatgttgcagatacccttgtccttgcagatttgcacagtgcagaacagttgaaagcacaagccatagactttattaataggtgcagtgtacttcgacaacttgggtgtaaagatgggaaaaactggaacagcaaccaagcaaccgacataatggaaacatcagggtggaagtccatgattcagtctcaccctcatttagtagcagaagcctttcgagcactagcatctgcacagtgtccacagtttggcattccacgcaaacggctaaaacagtcctgaaatcttccatgaacagttgaaaaatggaattgactttcactcctccaggtccagaaggattctaatacacaaaccataagcaagagttgtttctgttattttgtccacagaacagaagctgaaaaagcatattgcttgcatttcaggtggataatttatggtttattcttcagctttaaattagactgattaattcacttcaaggccttaaattatcttcaatgacttgtcttgttcatataatactttaatttttttttattgtgccttgtcattttgaccaaggctatgcaggattgcactagctccataatgcagtaatattgataactgaagatactaagtttcaaaaggatcttccattattttgcaaaaagaaaaatgaattttatagggtttgtcctatgctatctcaaagtttaagttctctttaaaagcacttgtattggagattaccagtaatatctccaatctaagttctataaatatgggagaaccctcttaccttcaaggtaagttatggcaatacactgcttcaattctaatttatttttcatttcagggggcaaatatgcaatgagttggcctagatttttagtgacatttatgatgtttgtcttgtatgttaactgtccaacaaactgtgggtttattctaagtttacaattattgagaactgattgaggttaagatttcatgaagaaagcatgtattgtgtggaagtaatttttttttaatttatactgacctacatttatacgaagaattctgtacatgttaaaagtaaggatgaccaaatgcaaatttaatgagtgggccaattaagaaagatacatatgcacttttactgtgtaacttttgtatgctgaatggtacatatatttttttgcttttgagggaattaataaggtataattaattgtgtcttaacttttcaaagaaatttttagatggaggcaactgggatgtttgtgataatagatgagaaagacatccttgattgtagttaaattggtttggattacagatattcattattgaattgactcctattttctcacactttggaaaagacacctgaacaataaatgaatcctggatagtctactctccttcaaacaattaactgatacttgcctttgggagatgcatacaaaaggagagaacccttagactatgtcaggtcacactaggaacctcccctcactccccgtttttcttcattgtgtttcagttactgtactaacattgtggatgatactgaaattctgcataatgtgaacaggataaactatttataaactgcttttcatgggccagttctttattataaatgaattttagctttaaatgcatatacacgttcagtgtttgatagttgtgttcttaagggaggtttgttctggtgcattgtcctggagaagcagaagcagtcagtgttggggtaccacatctgacttactgtggtggtgaccagtgtgcttcttaagggcaagatttatatttgaccacaagggaaaaagtgtgtcactggaaaaaaacgcatatacctatgtttgcaaacataactattcttcagattaaaatttgtataatttgtttatttaatgtttgaattcaggacaaaagaaaaaatgaagcttgaggtgttttcaaatagaccttatttttgctatctctttgttaggtgttaactgaagcaattcgaatatgtccagattcatttggattcatatttacattgaaaaaactcaactaagcatttgttatccacaacaacctagagtttaaaaagatcgtattttcacctgtcttcattactttctatgtagtttcattctttgtcgtggtaacttaaatttgaaattggaagaatctcttgggatagaagaaagattcttacctggtgatggaacttcatacttcatcctgtgtaagagtattatgggaagtagaaattcacttccttaaatccatcgtaagattgagcctcaagtttgcaatatacaattttaaaaatacacatacatacatacatatgtatacatttccagttttaagattttgcgagggtcttataagaaaacaaaaattccctcaggctatagaattatgttgtcatatatcagaaaagtactgatgtatccatttatatccaatgcgcaccacaccggcacattgtgatttaattcaccgcttgaatctatatttctaaccacagtgacttcagtaaaaataccgtataatgaacatttcagcttcttcttacttactcgagagtttattgcaaatcttaaggattttattataaagattttttttttagtttggtagcacattttgtaccaaaaatgtcaaacactgtgctgtaagaatatccatgtttgtagaaatgtccacttttcagataatataatgcctaccattatactaacagaatcatatggtagttgatttatttttttatttattatgtatatttttggtattgtgggttcttgaggcaatgataaaaacacttaatgtattctgacatgagtgctctaatagcctccttctcctcatttttaaactgcatacattactttcaaaataggtatagatactctgtcccgccttttgagctattagcctgttcctgtttccctttgtcacctaagcaaggctttttctgagaaggtagtgaatggtttcaaatgttgcatactataagaataatcattgggtaactgttgtttagaccaacacttagaaatactatatttgtgccttttcatttttaattttaatgtgtgttgatatttggagcacaaataatgaaggtgccataatatggcttgccaatgttacctccttgaatagtcatgtgtcattgtcttgaattggtaattggagaaccttgcatgaaatatgtgatcgtgtgtgtgtgtgtgtatgcgcgtgtgtgtctgtgtgtttgtgtacatacctgtatttgcttggggcttgtgtgtggtatgttacaaagagtgaatttctggaaatagaaatcagttaaatgttgaaagttcaggttagcagaaatatttcatttaaatatgctttactttggaggacaattgattaacagaggaaatgataattttcaaaaatgtgatcaatttactgcatgatgaaatgtgaaaacagtgcctttttaggacatcaattataataaaattgttttaaaatattaacaaagatctcaaaaagttgtcatgaacattattcatttatttttaaactggatctaaataagagcttagatggccaaaattagaattaataatatacccatttaaattttgttcataaatttaaaatcttaatcagaattctttataaaatgtgggtcatagatatgacccagtgttactaaaatagaacagggattgtgaaaatccagctcaacatacttaagtatacttggcttagagccaagtatacttgaagaggtgaattattctgacttggacatgcatgctctttgatggataaaataaaaatattcaatttattcttacaaaagaaggtgggtgggtgagtgggttcgttttagtgttctcagattataaagacagctataaagacagcactttccgcacacaaagtgtattttacaaaccttttttatacaaattaatgagctctactttatttaagtgttcatggaatgatgtaaattttaggtccagttgaacaaatattgagtgcctatcatatgcaagactaactccttactaggaatgaaatcacacagtgtcttctgtttgcagtatgtgaactttatgtttgaaaagaaattattatatttaaatttttttgttgtcagagtttatcattgtatactgtaacccagtaaattttgcattcagttttaaaaaatgaagatgtaacttacctgagtctcatttttgaaaatgaaattctgcaaaaattatttaaaaattagttcttggggaaattgattttcaagattcaagtgtataaaaacttatattgaacttttcagcctcgtttttaattagctgatgttaatgataagatacataatacatgtatcttgttgctgaaaatattttttgcatttcaacacattgagttaaaataaagttgttactacttattcaagattaattggcttatcttgtgtttatttgaagaatacatactcttctttttcaggttggtatgatgctttgcaaaagagccatgtatttgatacggtaaatcatgcatagtaattgtcttttctacataggggagctcttgttttttggaaccaattgaagacattcttaactgtaaaatattaatatgcatttattttaatatgtatgaaccatcaatactggatgacttattctaatgctacgtaccattaatgtaacagagatcaccttttccctgtcattcctatcctgtcttaatttcagttatcccagacaa

SEQ ID NO: 185302 - DNA, 1386 bp, Homo sapiens
  Payload ID: 16493
  Gene Symbol: SPOPL
  Gene Name: speckle-type POZ protein-like
  ENST ID: ENST00000420679
  CDS Start-End: 61-633
gtaaggtactcaactgtgtggggtactacataaatcctgaaagactacaataaagtggtgatgtctcgggaacccaccccacctctacctggagatatgtctactggtcccatagcagaaagctggtgttacacacaggttaaagtagtaaaattttcctatatgtggaccattaataacttcagtttttgtcgagaggaaatgggtgaagtgttaaaaagttcaacattttcatctggcccaagtgacaaaatgaaatggtgcctgagggtaaacccaaagggattagatgatgaaagtaaagactacttgtccttatatttgcttttagtcagctgccccaaaagtgaagttcgagcaaaattcaaattttcccttctgaatgctaaaagggaagaaacaaaagcaatggaaagccaaagagcatatcgatttgtgcaagggaaggactggggttttaaaaaattcattagaagggactttttgcttgatgaagctaatggtcttttaccagatgacaagcttacattattttgtgagaatctccagcactgcttgcagaagaggaggaagcattgcactacccttcctaaagaactgcctcctccccctcccctgcaagtggtgctgtagacaggtgagtgtggtccaagattcagtaaacatatcaggacatactaatacaaatactttgaaggtgcctgagtgtcgtctagcagaagatttaggtaatctctgggaaaacacaagatttacagactgcagttttttcgtgagaggacaagaatttaaagctcataaatctgtgcttgcagctcgatctccagtttttaacgccatgtttgaacatgaaatggaagaaagcaaaaagaatcgagtggaaataaatgatttagaccctgaagtttttaaagaaatgatgagattcatttacacagggagagcaccaaaccttgacaaaatggctgacaacttgttggcagctgcagacaaatatgcactggaacggctgaaggtcatgtgcgaagaagctttgtgtagtaacctctcagtagagaatgttgcagatacccttgtccttgcagatttgcacagtgcagaacagttgaaagcacaagccatagactttattaataggtgcagtgtacttcgacaacttgggtgtaaagatgggaaaaactggaacagcaaccaagcaaccgacataatggaaacatcagggtggaagtccatgattcagtctcaccctcatttagtagcagaagcctttcgagcactagcatctgcacagtgtccacagtttggcattccacgcaaacggctaaaacagtcctgaaatcttccatgaacagttgaaaaatggaattgactttcactcctccaggt

SEQ ID NO: 185303 - DNA, 558 bp, Homo sapiens
  Payload ID: 16493
  Gene Symbol: SPOPL
  Gene Name: speckle-type POZ protein-like
  ENST ID: ENST00000430968
  CDS Start-End: 249-467
ggagatagggaaggagggcgggtcggggaggagggatgcggttcggcggaggcggccgccacagggacttgccgccatcacccctgctgccaccaccgcagcctcgggctcccagggcggacacggccaccgcctcagcgggagaggagtctccaccaggactgaccgctgccgcccagcacgtccaggtaaggtactcaactgtgtggggtactacataaatcctgaaagactacaataaagtggtgatgtctcgggaacccaccccacctctacctggagatatgtctactggtcccatagcagaaagctggtgttacacacaggttaaagtagtaaaattttcctatatgtggaccattaataacttcagtttttgtcgagaggaaatgggtgaagtgttaaaaagttcaacattttcatctggcccaagtgacaaaatgaaatgtcagctgccccaaaagtgaagttcgagcaaaattcaaattttcccttctgaatgctaaaagggaagaaacaaaagcaatggaaagccaaagagcatatcgatttgtgcaa

SEQ ID NO: 185304 - DNA, 26584 bp, Homo sapiens
  Payload ID: 16494
  Gene Symbol: SYNE1
  Gene Name: spectrin repeat containing, nuclear envelope 1
  ENST ID: ENST00000341594
  CDS Start-End: 654-25832
cccgggcagtggaaaccgtgggcaaaagttagctggcaggacagcgcagctcctccaggcagcggaggcagcgcgtcccggctctcagggacatttccttcccacctcgacccccgggaggtggtcccggtataaaggctcgctgagcgggtgggtcacagcacagctttgcagctgcggagaaacgcccaaggccgtgcatctccaggagggcggctgggctcccgcagtcctgcagaccgcgcccgatcccggcgacagggcgggcggacagccgcgcatccccggggtcccgccgagcctgggcgcagagagccgggaggaagcgttcgctcgcttcgccttgctgctgggaaactgaacgaggccgagagagaaggttcttgagttcatgtaagaggacagtcttaaaacggaagaagaaaaagaagcagttcagtctttgggagagctgcctccttgttgagtgctgcaaaggcctggaattcatttatgacagaatagatctagaaaagtccaagcatgttttctagagtggtgtagccctgtgctgcctccagtgaagagtctcttggtgttggcttcgtgcttccggagggaccatggcaacctccagaggggcctcccggtgtcctcgggatatcgccaatgtgatgcagaggctgcaagatgagcaagagatagtacaaaaacgaactttcacaaaatggatcaactctcatctggccaagcggaaacctccaatggtggtggacgatctttttgaagacatgaaagatggtgttaaactgcttgcccttctggaggtcctgtctgggcagaaactgccttgtgaacaaggacgccggatgaagcgaatccatgctgtggctaacattggcacggcactcaagttcctcgaaggaagaaagattaaattagtcaacattaactccaccgatatagctgatggccgaccctcaatagttcttggattgatgtggaccattattctatatttccagattgaagagttgaccagcaacctgccccagctccagtctttgtccagcagcgcatcctccgtggacagcatagttagctctgagactcccagcccaccaagtaaacggaaggtgaccaccaagatccaaggaaatgctaagaaggctttattaaagtgggttcagtacacagctggcaagcagactggaatagaagtaaaagattttgggaagagttggagaagcggggttgcctttcattcagttattcatgccattcgaccggaattggtggacttggagacagtgaaaggcagatccaaccgagaaaatttggaggatgctttcactatcgccgaaacagaactggggatcccaagactgctagatcctgaagacgttgatgtggataaaccagatgagaaatctattatgacctatgtagcccagtttctgaaacattatcctgacatccacaatgcaagcactgatgggcaagaggatgatgaaatacttccaggtttcccatcttttgcaaattctgtacaaaattttaagagagaagacagagtaatttttaaggaaatgaaagtttggatagaacaatttgagagagatttgacaagagcacagatggtggaatcaaatttacaggataaatatcagtcatttaagcacttcagagttcaatatgaaatgaagaggaaacagattgaacatttaatacaaccattacacagagacggtaaattgtcacttgaccaagcattggtaaaacaatcttgggatagagtgacctccaggctctttgactggcatatacagcttgataaatctcttcctgcacctctgggcaccataggtgcctggctgtacagagcggaggtggccctgagagaggaaataaccgttcaacaggtccacgaggaaacagcaaacacgatacaacggaaacttgagcaacataagagaaaatgccagacaatcatggatctgcttcaaaacacggatgcccacaaaagagcattccatgaaatctaccggaccaggtctgttaacgggattccagtgccacctgatcaattagaggacatggccgagaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctgaaaaaatgctcaatcaatcagaaaatgccaaaaaggatttttttcgaaatttacctcattggattcagcagcatactgccatgaacgatgctggcaattttctaattgaaacctgtgatgagatggtttcccgtgacctgaagcagcaattactgttgctaaatgggcggtggagggagttgtttatggaagtcaagcaatatgctcaagctgatgagatggacagaatgaagaaggaatacacagactgtgttgttaccctgtctgcttttgcaacggaagcccataagaaactttctgaacccttagaagtctcttttatgaatgtcaagctattaattcaagacttggaggatattgagcagagggtgcctgtgatggatgcccaatacaagataattacaaagacagcacacctcattaccaaagaaagcccccaagaagaaggaaaagaaatgtttgcgaccatgtcaaagctcaaagagcagctaaccaaggtcaaagaatgttactccccactcctttatgagtctcagcagctgttgattccgttggaggaattagaaaagcagatgacgtccttttatgactcacttgggaaaatcaatgaaattatcacagttcttgagcgtgaggcacaatcgagtgccctttttaaacaaaaacatcagttgaggatactgaaatgcaaatggtgtaattcaagccaaaaaatgaccctctgccttgtgctgggctcaatgatttccatgctgtctactgccaaaatcacaattgcaggctacaagtcagaggtggaggtgtctgaactgttagcttgtcaagaaaactgtaagaaaaccttgacacttattgagaaaggcagtcaaagtgttcaaaagtttgtgaccttgagcaacgtgttaaagcattttgatcagacgaggctacaaacagattgcagatattcatgttgcttttcagtaatgagaaagcagcatcacattatgattgtttttcacatcaagagtatggtaaagaaaactggagattggaagaagcatgtggaaaccaacagtcgcttgatgaagaagtttgaggagtctcgagcagagttggagaaggtactgcggattgctcaggagggcctggaggaaaagggggatccagaggagctcctgcggagacacactgagtttttcagtcagctggatcagagggtgctcaatgctttcctgaaagcttgtgatgaactcaccgacatccttccagagcaggagcagcaggggctgcaggaagctgttcgaaagctccacaaacaatggaaggatcttcaaggagaagccccttatcatttgcttcatctgaagattgatgtggagaagaataggttcttagcctctgtagaagaatgcagaactgagctggatcgagagaccaagctgatgccccaggaaggcagtgaaaagataattaaagagcacagggttttcttcagtgacaaaggtcctcatcatctctgtgagaaaaggttacagctcatcgaggaactctgtgtgaaactcccagtgcgggacccagtaagggacacacctggaacctgtcacgtgactctcaaagagctcagagctgccattgacagcacctacaggaagctcatggaagacccagacaagtggaaggactacactagcagattctctgagttctcatcttggatatctacaaatgagacacaattaaaggggatcaagggtgaggccatcgatactgccaaccacggagaggttaaacgtgccgttgaagagatcagaaatggtgttaccaaaaggggtgagaccctcagctggctgaaatccaggctgaaagttttgacagaagtttcttctgagaatgaagcccaaaagcagggagatgagctggcaaaattatccagctctttcaaggctcttgtgacgctgctgtcagaggttgaaaagatgctaagcaattttggggactgtgtccagtacaaagaaatagtcaaaaattctctcgaagaattaatttctggctctaaagaagtccaggaacaagctgagaagatcttggatactgaaaatctgtttgaagcacagcagttacttcttcatcaccagcaaaagacaaagcggatctcagcaaagaagagagatgtgcagcagcagatcgcgcaggcgcagcagggagaaggggggctgcctgaccgaggccacgaggagctgcggaagctggagagcacactggatggcctggagcgcagccgggagaggcaggaacgccgcatccaggtcacattaagaaaatgggagcgatttgaaacaaacaaagaaacagtagtaagatacctttttcaaacaggttccagtcatgaacgcttcttgagttttagcagtttggaaagtttatcttcagaactggaacaaacaaaggagttttctaaacggacagaaagtattgcagtccaggctgagaaccttgtaaaggaagcttcagagataccgcttgggccccaaaataagcagctgcttcaacagcaggccaagtcaatcaaagaacaagtcaaaaaattagaagacacgcttgaagaagagtatgtgattgacaataaaaccatggaaatggtgaaaaccaagtgggatcattttggcagtaattttgagactctgtccgtctggataactgagaaagaaaaagaactcaatgccttggaaacttcgtcatctgccatggacatgcaaatcagccaaattaaggtcacaattcaggaaatagaaagtaagctcagcagcattgtaggattagaagaagaagcccagtcttttgctcagtttgttaccactggagaatctgctcgaattaaagccaagttgacacaaataagaagatacggggaagagcttcgagagcatgcacagtgtctggaaggaacaatcctgggacatttatctcagcagcaaaagtttgaagagaaccttagaaagatccagcaatctgtgtctgaatttgaagataaacttgctgttccaattaaaatatgttcttcagctacagaaacatacaaagttcttcaagaacatatggatctctgccaggccctggagtcactgagcagcgcgatcactgccttctcagccagtgccaggaaggttgtgaacagagattcctgtgttcaggaggctgcggctctacagcagcaatacgaggacatcctaaggagggcgaaggagagacagacggcgctggagaatctgctggcccactggcagaggctagagaaagaactatcatcctttttgacctggttagagcggggtgaagctaaagccagttccccagaaatggacatttctgcagacagagtcaaagtggaagcctccaaagatgatgtgaaaatgatgaaactacatttggagcagttggatgagagatggagagatttaccacagatcattaacaaaaggattaattttcttcagtctgtggttgctgaacaccagcaatttgatgagctgctgctttccttttctgtctggattaaactgtttctcagtgaattacaaactacctctgagattagcataatggaccatcaagtagcccttactcggcataaggaccacgcagcagaagtagagagcaaaaagggcgaattgcagagtctgcagggtcacttagcaaagttgggttctctgggccgtgctgaggacctccacctcctgcagggaaaggctgaggactgcttccagctgtttgaggaggccagccaggttgtggagaggcggcagcttgccctgtcccatttggcagaattcctccagagccatgcctctctgtccggcattctccgccagctgaggcaaacagtggaagcaaccaacagtatgaataagaacgagtctgatttgatagaaaaggacctcaatgatgctcttcaaaatgctaaagcattagaatctgctgccgtcagtctggatggcattctttccaaagcccaataccatctgaaaatcgggagctctgagcaaaggacttcctgcagagccacggctgatcagctctgtggagaggtagagaggatccagaaccttctgggaaccaagcagagtgaggcagatgctctggcagtgttgaaaaaagcattccaagaccagaaagaggagcttctgaaaagcattgaggacattgaagaaaggactgacaaagagcgattgaaagaacctacccgccaagctcttcagcagaggttaagagtgtttaatcagctagaagatgaattgaattctcacgagcatgaactatgttggttgaaagacaaagccaagcaaattgcccagaaagatgtagcttttgcacctgaagttgacagggagataaaccgcttagaggtcacctgggatgataccaaaagactaattcatgaaaatcagggtcagtgctgtggacttattgacttaatgagagaatatcagaacctgaaatcagctgtatctaaagtcttagaaaatgccagcagtgtgattgtaaccagaactaccataaaagatcaggaggatcttaaatgggctttttccaagcatgaaactgccaagaacaaaatgaattacaaacagaaagacttggataactttaccagcaaaggaaaacacttgttatctgagctgaagaaaattcacagtagtgatttcagcttggtgaaaacagacatggagagcaccgtggacaaatggctggatgtatcagagaaacttgaagaaaacatggataggctgagagtaagcctgtccatttgggatgatgtactgtcaactagagatgagattgagggatggtcaaacaactgcgttccacagatggcagaaaacatcagcaacctggataaccacctcagagctgaagaactgcttaaagaatttgagtctgaagttaaaaacaaagcattgagattggaagaactgcattccaaagttaatgatctgaaagaattaactaaaaatctagaaacaccgccagaccttcagtttatagaagcagacttaatgcagaaactggagcatgccaaagaaataactgaagtagcaaaaggaaccctgaaggatttcacggctcaaagtacacaagtggagaagtttattaatgacataacaacatggttcacaaaagtggaagaatcgttgatgaactgtgcccaaaatgagacttgtgaagcattgaaaaaagtcaaggatatacaaaaagaacttcaaagtcaacaaagcaacatcagctctacccaagaaaatctcaatagcttgtgccgcaagtaccactcagctgagttggagagcctgggccgtgcaatgactggtctgataaagaaacatgaagccgtgagccagttgtgctccaaaacccaggccagcctgcaggaatctctggaaaaacacttcagtgaagagtctatgcaggaattccaagaatggtttttgggagcaaaggcagcagcaaaagaatcatcagatcgcaccggtgacagcaaagttctagaagcaaagctccatgatcttcagcagaacattttggactcagtcagtgatgggcagagcaaacttgatgcagtgactcaagaaggacaaactttgtatgcacatttgtctaaacaaattgtcagtagcattcaagaacaaatcacaaaggccaatgaagagtttcaagcatttctgaaacaatgccttaaagataagcaggctcttcaagactgtgcttcagaacttggaagctttgaagatcagcacagaaaactgaacttatggatccatgaaatggaagaaaggttcaatacggaaaacttgggagagagtaaacagcacattcctgagaagaaaaatgaagttcataaagttgaaatgtttttgggagaactgctggctgcaagagagtctcttgataagctttcccagagagggcagcttctgagtgaagaaggccacggtgctgggcaggagggccgcctgtgttcccagctcctcacaagccaccagaacctacttagaatgaccaaagagaaactccggagctgccaggtggcccttcaggagcacgaagccctggaggaagcactgcaaagcatgtggttctgggtgaaggccattcaggacagactggcctgtgcagagagcactcttgggagcaaagacaccctggagaaacggctgtcacaaatacaggatattctcctgatgaaaggtgaaggggaagttaagttgaatatggccattggcaagggggaacaggccttgagaagtagcaacaaagaaggtcagagggtgattcagactcagttagagacccttaaagaagtgtgggctgacatcatgagctcctccgtccacgctcaaagcactttagagtctgtgattagccaatggaatgactatgtagagaggaaaaaccagttggagcagtggatggaatcagtggatcaaaaaatagaacatcccttacaaccacagccaggtctgaaagagaagttcgtcctgcttgaccacctccagtccatcctgtctgaggcagaagatcacacgagagcccttcaccgtctaattgcgaagtccagggagctctacgaaaagacagaggatgagtctttcaaggacacagctcaagaggagctgaaaacacagtttaatgatataatgactgttgccaaggaaaaaatgaggaaagtggaagagattgtgaaagatcatctaatgtatttagatgcggtccacgagttcacagattggctccattcagcaaaggaagaacttcaccggtggtcagatatgtctggagattcatcagccacccagaaaaagttatcaaaaattaaggagctgatagattccagagagattggtgcaagccgtctcagcagagtggagtcgctggctcccgaagtgaaacagaacacaactgccagtgggtgtgagctcatgcacacggagatgcaggccctgcgtgccgactggaagcagtgggaagacagtgtattccaaacgcagagctgtttggagaacctggtcagccagatggccctttcggagcaggaattctcaggccaagtggctcaactggagcaggccctggaacagttcagtgcccttctgaaaacctgggctcagcagttaaccctcctggaaggcaagaacacggatgaggagatagtggaatgctggcacaaaggacaagagatactggatgctttgcaaaaagcagagcctagaacagaggatctcaagtctcagctgaatgaactttgtcgattttccagagacctgagtacctacagtggaaaagtttctggcttgattaaagagtataattgtctttgtttgcaagcatccaagggctgccagaataaagaacagattttacagcaaagatttcgaaaggccttcagggatttccagcagtggttggttaatgcaaaaatcactaccgccaagtgttttgatatacctcaaaatataagtgaagtttcaactagtcttcagaaaatacaggagtttttgtcagaaagtgaaaatggacagcacaagctaaacatgatgctgtctaaaggggaacttctgagtaccctgctgaccaaagagaaagcgaaagggatccaggccaaagttacagctgcaaaagaagattggaaaaattttcattcaaatctccaccaaaaagaatctgctctagagaatctaaagatccaaatgaaggactttgaagtaagtgctgagcctatccaggactggctgagtaaaactgagaagatggtccatgaaagcagcaatcgcctctatgatctgccagcaaagaggagggagcagcagaagctccagtctgtccttgaggaaatacactgctacgagcctcagctcaacaggctgaaagagaaagctcagcagctgtgggaaggacaagctgccagcaagagctttaggcacagagtgtcgcagctgtcttctcagtatctagcgctaagcaatttaacaaaggagaaagtgtcaagactggatagaatcgttgcagaacacaatcagttctctcttgggattaaagaattacaagactggatgacggatgcgattcacatgctggattcatactgccacccgacatccgacaaaagtgtgctggacagcaggacgctcaagctcgaggctctattatcagtcaaacaggaaaaagagattcagatgaaaatgatagtgaccaggggagaatctgtccttcagaatacttctccagaaggcattcccactattcagcagcagctgcagagtgtgaaggatatgtgggcatcccttttgtctgcagggattcgttgtaaaagggtgaggctcccctgtgcctatattgccctcaaactgagagtacatcagcatgcggagctgcgggataaaacaacgatgctcggaaaagccaaggaagccgtaaccaagtctgaaaaacttgtccgcctgcaccaagagtatcagagagacctaaaggcatttgaagtttggttggggcaagaacaagaaaagctcgaccagtattcagttcttgaaggtgatgcccacactcatgagacaacattgcgtgatcttcaggagctacaggtacactgtgcagaggggcaggccctgttgaactcagtgctgcacaccagagaggatgtgatcccatcaggtatcccacaggcagaggaccgggctttagagtctctccggcaagactggcaggcttaccagcacaggctgtccgagactcgaactcagttcaataacgtggtgaacaaattgaggctaatggagcaaaagtttcagcaagtagatgaatggctcaaaacagcagaggagaaagttagtcccaggaccagacgtcagtctaacagggcaaccaaggagatacaattacatcagatgaagaagtggcacgaagaagtgactgcatacagagatgaagttgaggaagtgggagctagagctcaggagatactggacgagagccacgtgaacagcagaatgggttgccaggccacccagctgacttccagataccaggccctgcttctccaagtgctggaacaaataaaattcctggaggaggagattcagagtttggaggaatcagaatcatccctcagttcctattctgattggtatggctctactcataaaaacttcaagaatgtggctaccaagattgacaaagtagatacagtaatgatggggaagaaattgaagacgttggaggttttgctcaaagacatggagaaaggtcacagtttgctgaaatcagcccgggagaaaggagagagggctgttaaatacttggaggaaggcgaggcagagaggttaagaaaggagattcatgatcacatggagcagttgaaggaactgaccagcactgtccggaaagaacacatgacgctggaaaaatcacttcaacaaacggtgctgtcccatgaaccatcagtaaagtcagtgagagagaagggtgaagctcttttggaactggtgcaggacgtcactttaaaggacaaaatagatcaacttcaaagtgattaccaggacctgtgcagcataggaaaggagcatgtcttcagtctggaggcgaaagtcaaagaccatgaagactacaacagtgagctccaagaggtcgaaaagtggctgctgcagatgtctggcagactggtggcacctgacctcctggagacaagcagcctggagacaatcacccagcaattggcccaccacaagatgtaccagagtttggaacacgaacttcagaagcacgtcagccgacaagacaccctgcagcagtgccaggcctggctttctgcagtccagccggatttagagccaagtcctcaaccacctcttagtagggcagaagccattaagcaggtcaaacacttcagagctttgcaagagcaggcaaggacctacctagatctcctttgctccatgtgtgacctgtcaaatgcttcggtgaaaaccacagcaaaagacattcaacaaacagagcaaacgattgaacaaaagcttgtccaggcccagaacttaactcagggctgggaagagatcaagcacctgaagtctgagctctggatttacctgcaagatgctgatcagcaactgcagaacatgaagaggaggcactctgagctggagctgaacattgcacagaacatggtttcacaagttaaggattttgttaagaaactacagagcaaacaggcatccgtgaacaccataatagaaaaggtgaataagttaacaaagaaggaggaatcgcctgaacacaaggaaataaatcatttaaatgatcagtggctcgatttgtgccgtcagtctaacaacctgtgcttgcaaagggaagaggatcttcagagaacaagagattaccatgactgtatgaatgttgttgaagtgttcctagaaaaatttactacagaatgggataacttggccagatctgatgcagagagtacagctgtccacctggaagctttgaaaaagttagcattggcattgcaggagagaaagtatgctattgaagatctgaaagatcaaaagcagaaaatgatagagcatctgaatttagatgacaaggagttagtcaaagaacagacgagtcatttagagcaacgttggtttcagcttgaggacctcattaaaaggaaaatccaagtgtcagtcaccaacttggaggagttaaatgtggtgcagtccagatttcaggagctaatggagtgggcagaagagcaacaacccaacatcgccgaggcccttaagcagagccctcctccagatatggctcagaaccttctcatggatcacctggccatctgcagtgaactggaggccaagcagatgctcctgaaatcgcttataaaggacgcagacagggtcatggcagatcttggtctcaatgagcgacaggtcatccagaaggctctctctgatgcacaaagccacgtgaattgtctcagtgacttagtgggccagcgaagaaagaagcattttaaggaagattttgataaagcttgccactggctaaaacaagcagatattgttacatttcctgaaatcaacctaatgaatgagagttctgagcttcatacacaactggctaaataccaaaacattcttgaacaatctccagaatatgaaaatcttctacttacgctgcagagaactgggcagaccatattaccatcgctgaatgaagtcgatcattcctacctcagtgaaaagctaaatgctttgcctcgacaatttaatgtaattgttgccttggctaaagacaagttctataaagtccaggaagcaattcttgctcggaaggaatatgcttccttgattgagttgacaacccagtctctgagtgaacttgaagcccaattcttgaggatgagcaaagttcccaccgacctggccgttgaggaggctctttctctgcaagatggttgcagagccattctggacgaggtggcgggccttggggaggcggtggatgaactgaaccagaaaaaagaaggttttcgcagcacaggtcagccttggcagccagacaagatgctgcaccttgtcaccttatatcacaggctgaagcgacaaacagaacagagggttagcttattagaagacaccaccagtgcttaccaagaacacgagaagatgtgccaacagctggagagacaactgaagtctgtaaaagaggagcagtccaaagtgaatgaggaaacgctgcctgcagaggagaagctcaaaatgtatcactccctggcaggaagtctccaggactcagggattgtactgaaacgagtaaccatacatcttgaagatcttgccccacaccttgaccccttggcttatgagaaagccaggcatcagatccagtcctggcaaggggagttaaaactgttgacttctgccattggtgagacggtgacagaatgtgagagccgaatggtgcagagtatagacttccagactgagatgagtcgctccctggactggctgaggagagtgaaggcagagctcagtgggccggtgtacctagacctcaacctgcaggacatccaagaggaaatcagaaaaatccaaattcatcaggaagaggtccagtccagcttgagaatcatgaatgcgctgagtcacaaggaaaaggagaagttcacaaaggccaaggagctgatttctgcggatttagaacacagcctcgctgagctctcagagctggatggagacatccaggaagccttacgcaccagacaggctaccttgactgaaatatatagccagtgtcaaaggtattatcaggtatttcaagcagccaatgactggcttgaggatgcccaagaattgttacagctggcaggcaatggcctagacgtggagagcgcagaggaaaatctcaaaagccacatggaatttttcagtacagaggatcagttccatagtaacctggaggagctccacagcctggtagccaccctggacccactcatcaagccaaccggcaaagaagacctagaacagaaagtggcttctctggaactcaggagccagaggatgagccgggactctggtgcccaagctttagtgtcagtggttaactctttccatgagaaaattgtggcccttgaggaaaaagcttcacaactggagaaaaccggaaatgatgccagcaaagccaccctgagcaggtcaatgaccaccgtctggcagcgctggacacgccttcgagctgtggcccaggaccaggagaagatcctggaagatgcagtggatgagtggacgggctttaacaacaaggttaaaaaggccactgaaatgattgatcagctgcaagataagttacctggaagttcagcagagaaagcatcgaaagcagagctcttaactcttcttgaataccacgacacgttcgttctggagctggagcagcagcagtcggccttgggcatgctgcggcagcaaaccctgagcatgctccaggatggagccgccccaacccctggggaagagcctccgctcatgcaggaaatcaccgccatgcaagatcggtgcctgaaaatggtggagactcagatcaattctgtgaaatgttgggttcaggaaacgaaagaatatttagggaatccaacaatagaaatagatgctcaacttgaagaacttcagattctcctaacagaagccacaaatcaccgacagaacattgaaaaaatggcagaagaacagaaggagaagtacttaggtctttataccatattaccttctgaactctcccttcagttggctgaagtggcgttagatctaaagatccgagatcagatccaagacaaaataaaagaagttgagcagagcaaggccacgagccaggaactcagccggcaaattcagaagttagctaaagacctcacaactattctaactaagctgaaagcgaagacagataatgtagttcaagctaaaactgaccaaaaggcagcatcacatttagaagaatacaatgaaatgcttgaattaattttgaagtggattgaaaaagctaaagtcttggctcatggaactattgcatggaattctgcaagccagcttcgggaacaatatattttgcatcagaccctgctagaagaatccaaagaaattgacagtgagctggaagcaatgactgagaaattacagtacctcactagcgtgtactgtacagaaaaaatgtctcagcaagtggcagaactgggacgggagactgaggagttgcgacagatgatcaaaattcgtttgcagaacctccaagatgcagctaaggatatgaaaaaatttgaagcagagttgaaaaagttacaagctgccttggagcaagcccaggcaacactgacttctccagaagttggacgtctcagtctcaaggagcagctctctcatcggcagcatttgttgtctgagatggagtcactgaagccgaaggtgcaagcagtgcagctctgccagagtgccctccggatccccgaggatgtggttgccagcttacctctctgtcatgctgctctgcggctgcaggaagaggccagccggctgcagcacaccgccatccagcagtgtaacatcatgcaggaagctgtggtacaatatgaacaatatgagcaagaaatgaaacatctccagcaactgatagaaggagctcacagagagattgaggataaacctgttgccaccagtaacatacaggagctgcaggctcagatttctcggcatgaggagctggcgcagaaaattaagggctaccaggagcagatcgcttctttgaattccaagtgcaagatgctgacgatgaaagccaagcacgccaccatgctgctgacggtgaccgaggtcgaggggctggcggaagggacagaggacctggatggggagctcctccccacgccttcggcccacccctctgtggtcatgatgactgcaggtcgctgtcacactttgctgtcaccggtcactgaggagtctggggaggagggaaccaacagtgagatttcctctccacctgcctgtcgctccccttcacctgtggctaatacagatgcttctgttaaccaggacattgcatattaccaagccttgtctgctgagaggttgcagacagatgctgcaaaaattcaccccagcacatccgcatcccaggagttctatgaaccgggattggagccatccgctactgccaaactgggtgatttgcagcgttcttgggaaaccttaaagaatgtgatcagtgagaagcagcgcacactctatgaagctttggaacgccagcagaagtaccaggactccctccagtccatctctacgaagatggaggccattgagctgaaactcagtgagagcccagagcctggcaggagtccagaaagccagatggctgaacatcaggcattgatggatgagattctcatgctccaggatgaaatcaatgagctccagtcctctctcgcagaggagctggtatccgagtcttgtgaggccgaccctgcggagcagctggccttgcagtccacgctcactgtcttagccgagcgaatgtccaccatcaggatgaaagcctcggggaaacggcagcttttggaggagaagttgaatgatcagctggaggaacaaaggcaggaacaggccctgcagaggtatcgctgtgaagccgatgagctggacagctggctcttgagtaccaaggccactctggacactgcgctgagtccacccaaggagcccatggacatggaggcccagcttatggactgccagaatatgctggtggaaatagagcagaaggtggtggctttatcagaactgtcagtccacaatgagaacctgctgctggagggcaaagctcacaccaaggacgaggccgagcagctggctggaaagctgagaaggctcaaggggagcctgctggagctgcagagagccctgcatgataagcagctcaacatgcagggaacagcacaggagaaggaggagagcgatgttgacctaacagccacgcagagccccggcgtccaggaatggctggcccaagctcgcaccacatggacccagcagcggcagagcagtctccagcaacaaaaagagttagaacaggaattagccgagcagaagagtctccttcgctcagtagccagtcgtggagaggagattctaattcaacattcggcggcagagacctctggtgatgctggcgaaaaacctgatgtgttatcccaggagttggggatggaaggggagaaatcatccgctgaagaccagatgagaatgaaatgggaaagcctacatcaagaatttagtaccaagcagaaactactacagaatgttctggaacaggaacaagagcaagtgctttatagcaggccaaatcgactcttgtctggtgtgccactgtacaaaggggacgtgccaacccaagataaatctgcagttacatctttgctggatggactgaaccaagccttcgaggaggtttcatcccagagtggaggggcaaagaggcagagtatacacttggagcagaagttgtatgatggagtctcagccacctctacttggttggatgacgttgaagaacgtttatttgttgccacagcacttttaccagaagaaacagagacttgtctcttcaaccaagagattcttgccaaagacattaaggaaatgtctgaagaaatggataagaacaaaaacttgttttcccaagcttttccagagaatggtgataatcgagatgttattgaagatactttgggttgtcttttgggcaggttatccttgctagactcagtagtgaatcaacgatgtcatcagatgaaagaaagacttcagcaaatactaaatttccagaatgatctgaaagtgctgtttacatcactggctgacaacaaatacatcattctgcaaaaactggcaaatgtgtttgaacagcccgtagcagaacaaatagaggcaatacaacaggctgaagatggactcaaagaatttgatgcaggaatcattgaattaaagaggcgtggtgacaagctacaggtcgagcagccgtccatgcaagaactctccaagctccaggacatgtatgatgagctgatgatgatcattggctcccggaggagtggtctgaatcagaaccttacactcaagagtcagtatgagagggccctacaagatctggctgacctgctagaaactggtcaggagaagatggcaggagaccagaaaatcatcgtgtcttccaaagaggaaatccagcaactacttgacaaacataaggaatactttcagggcctggaatctcatatgatcttgactgaaacactcttcagaaagataatcagctttgcagtccaaaaggaaacccagttccatacagagctgatggctcaggcttctgctgtactgaaacgggctcacaagaggggtgtggagctggagtacattctagagacgtggtcccatctggatgaggaccagcaggagctcagcagacagctggaggtggtggaaagcagcatcccaagcgtgggtctggtggaggagaacgaggacaggcttattgaccgcataacactctaccagcatttaaaatctagccttaatgaataccagcccaaattatatcaagtattagatgatgggaaacgacttctgatatccatcagctgctcagatctagaaagccaactaaatcaacttggagagtgctggctaagtaacaccaataaaatgtctaaggaacttcacagactggaaacaatattgaaacactggaccagatatcaaagtgaatctgcagatctaattcactggttacaatctgcaaaagaccggctagaattttggactcagcaatctgtgacagtcccacaagagctggaaatggtccgtgatcatctaaatgctttcctggagttttctaaagaagtggatgcccaatcttccctgaaatcatctgttctgagtactggaaatcagctccttcgactaaaaaaggtggacacagccacgctgcgctctgagctgtcgcgcattgatagccagtggactgacctgctaaccaatatcccagccgtccaggagaagctccaccagctccagatggataaactgccttcccgccatgccatttctgaagtcatgagttggatttctctaatggaaaatgttattcagaaggatgaagataatattaaaaattccataggttacaaggcaattcatgaataccttcagaaatataagggttttaagatagacattaactgtaaacagctgacagtggattttgtgaaccagtccgtgctacaaatcagcagtcaggatgtggaaagtaagcgtagtgataagactgattttgctgagcaacttggagcaatgaataaaagttggcaaattctgcaaggtctagtaactgagaagatccagctgttggaaggcttattggaatcttggtcagaatatgaaaataatgtacaatgtctgaaaacatggtttgaaacccaggaaaagagactaaaacaacagcatcgaattggagatcaggcttctgttcaaaatgcactgaaagactgtcaggatctggaagatttgattaaagcaaaagaaaaagaagtagagaaaattgagcagaatggacttgctttgattcagaacaagaaagaagacgtctctagcattgtcatgagcacactgcgagagctcggccaaacctgggcaaatttagatcacatggttggacaattaaagatactgctgaaatcagtgcttgaccaatggagtagtcacaaagtggcctttgacaagataaacagttacctcatggaggccagatactctctttcccgattccgtctgctgactggctccttagaagctgtgcaagttcaggtggacaatcttcagaatctccaagatgatctggaaaaacaggaaaggagcttacagaaatttggctctatcaccaaccaattattaaaagagtgtcacccacccgtgacagaaactcttaccaatacactgaaagaagtcaacatgagatggaataacttgctggaagagattgctgagcagctacagtccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctcttttttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttggcttatcaggggaccacagtgccctagagtcacagatccgacaactgggcaaagccctggatgatagccgttttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaaagatatttatgtatgtacagtttgctaaagccaagttttgtttgtattgatttctttgcatttattatagatattataaaatagtt

SEQ ID NO: 185305 - DNA, 3154 bp, Homo sapiens
  Payload ID: 16494
  Gene Symbol: SYNE1
  Gene Name: spectrin repeat containing, nuclear envelope 1
  ENST ID: ENST00000354674
  CDS Start-End: 148-3075
agtgtcatgttatcgggcagagactaccaacatttgtctacagtgagcattttcatacttctatacacagacaaggggaaactttcatccccacgcaggatatagctttttgctctgcagagtctaacttttgcaagtggaagcttcatggtggtggcggaggacctgagtgccctgaggatggcagaggacagctgtgtggatgcagatctcccagattgtaactgcgatgtcacaagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttggcttatcagatgtaatgatccccgaaagccctgaggcctatgtaaaactcacagaaaatgcaatcaaaaatacctccggggaccacagtgccctagagtcacagatccgacaactgggcaaagccctggatgatagccgttttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaaga

SEQ ID NO: 185306 - DNA, 7165 bp, Homo sapiens
  Payload ID: 16494
  Gene Symbol: SYNE1
  Gene Name: spectrin repeat containing, nuclear envelope 1
  ENST ID: ENST00000367248
  CDS Start-End: 470-4771
agccagccagggtgagcgcgggcgccgggccgcggccgccggccgcagcgggctgagattgttgtcctctgtcaccagggcggctgggctcccgcagtcctgcagaccgcgcccgatcccggcgacagggcgggcggacagccgcgcatccccggggtcccgccgagcctgggcgcagagagccgggaggaagcgttcgctcgcttcgccttgctgctgggaaactgaacgaggccgagagagaaggttcttgagttcatgtaagaggacagtcttaaaacggaagaagaaaaagaagcagttcagtctttgggagagctgcctccttgttgagtgctgcaaaggcctggaattcatttatgacagaatagatctagaaaagtccaagcatgttttctagagtggtgtagccctgtgctgcctccagtgaagagtctcttggtgttggcttcgtgcttccggagggaccatggcaacctccagaggggcctcccggtgtcctcgggatatcgccaatgtgatgcagaggctgcaagatgagcaagagatagtacaaaaacgaactttcacaaaatggatcaactctcatctggccaagcggaaacctccaatggtggtggacgatctttttgaagacatgaaagatggtgttaaactgcttgcccttctggaggtcctgtctgggcagaaactgccttgtgaacaaggacgccggatgaagcgaatccatgctgtggctaacattggcacggcactcaagttcctcgaaggaagaaagtccatgcacagaggatcaccgattaaattagtcaacattaactccaccgatatagctgatggccgaccctcaatagttcttggattgatgtggaccattattctatatttccagattgaagagttgaccagcaacctgccccagctccagtctttgtccagcagcgcatcctccgtggacagcatagttagctctgagactcccagcccaccaagtaaacggaaggtgaccaccaagatccaaggaaatgctaagaaggctttattaaagtgggttcagtacacagctggcaagcagactggaatagaagtaaaagattttgggaagagttggagaagcggggttgcctttcattcagttattcatgccattcgaccggaattggtggacttggagacagtgaaaggcagatccaaccgagaaaatttggaggatgctttcactatcgccgaaacagaactggggatcccaagactgctagatcctgaagacgttgatgtggataaaccagatgagaaatctattatgacctatgtagcccagtttctgaaacattatcctgacatccacaatgcaagcactgatgggcaagaggatgatagagaagacagagtaatttttaaggaaatgaaagtttggatagaacaatttgagagagatttgacaagagcacagatggtggaatcaaatttacaggataaatatcagtcatttaagcacttcagagttcaatatgaaatgaagaggaaacagattgaacatttaatacaaccattacacagagacggtaaattgtcacttgaccaagcattggtaaaacaatcttgggatagagtgacctccaggctctttgactggcatatacagcttgataaatctcttcctgcacctctgggcaccataggtgcctggctgtacagagcggaggtggccctgagagaggaaataaccgttcaacaggtccacgaggaaacagcaaacacgatacaacggaaacttgagcaacataaggatctgcttcaaaacacggatgcccacaaaagagcattccatgaaatctaccggaccaggtctgttaacgggattccagtgccacctgatcaattagaggacatggccgagaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctgaaaaaatgctcaatcaatcagaaaatgccaaaaaggatttttttcgaaatttacctcattggattcagcagcatactgccatgaacgatgctggcaattttctaattgaaacctgtgatgagatggtttcccgtgacctgaagcagcaattactgttgctaaatgggcggtggagggagttgtttatggaagtcaagcaatatgctcaagctgatgagatggacagaatgaagaaggaatacacagactgtgttgttaccctgtctgcttttgcaacggaagcccataagaaactttctgaacccttagaagtctcttttatgaatgtcaagctattaattcaagacttggaggatattgagcagagggtgcctgtgatggatgcccaatacaagataattacaaagacagcacacctcattaccaaagaaagcccccaagaagaaggaaaagaaatgtttgcgaccatgtcaaagctcaaagagcagctaaccaaggtcaaagaatgttactccccactcctttatgagtctcagcagctgttgattccgttggaggaattagaaaagcagatgacgtccttttatgactcacttgggaaaatcaatgaaattatcacagttcttgagcgtgaggcacaatcgagtgccctttttaaacaaaaacatcaggaactgttagcttgtcaagaaaactgtaagaaaaccttgacacttattgagaaaggcagtcaaagtgttcaaaagtttgtgaccttgagcaacgtgttaaagcattttgatcagacgaggctacaaagacagattgcagatattcatgttgcttttcagagtatggtaaagaaaactggagattggaagaagcatgtggaaaccaacagtcgcttgatgaagaagtttgaggagtctcgagcagagttggagaaggtactgcggattgctcaggagggcctggaggaaaagggggatccagaggagctcctgcggagacacactgagtttttcagtcagctggatcagagggtgctcaatgctttcctgaaagcttgtgatgaactcaccgacatccttccagagcaggagcagcaggggctgcaggaagctgttcgaaagctccacaaacaatggaaggatcttcaaggagaagccccttatcatttgcttcatctgaagattgatgtggagaagaataggttcttagcctctgtagaagaatgcagaactgagctggatcgagagaccaagctgatgccccaggaaggcagtgaaaagataattaaagagcacagggttttcttcagtgacaaaggtcctcatcatctctgtgagaaaaggttacagctcatcgaggaactctgtgtgaaactcccagtgcgggacccagtaagggacacacctggaacctgtcacgtgactctcaaagagctcagagctgccattgacagcacctacaggaagctcatggaagacccagacaagtggaaggactacactagcagattctctgagttctcatcttggatatctacaaatgagacacaattaaaggggatcaagggtgaggccatcgatactgccaaccacggagaggttaaacgtgccgttgaagagatcagaaatggtgttaccaaaaggggtgagaccctcagctggctgaaatccaggctgaaagttttgacagaagtttcttctgagaatgaagcccaaaagcagggagatgagctggcaaaattatccagctctttcaaggctcttgtgacgctgctgtcagaggttgaaaagatgctaagcaattttggggactgtgtccagtacaaagaaatagtcaaaaattctctcgaagaattaatttctggctctaaagaagtccaggaacaagctgagaagatcttggatactgaaaatctgtttgaagcacagcagttacttcttcatcaccagcaaaagacaaagcggatctcagcaaagaagagagatgtgcagcagcagatcgcgcaggcgcagcagggagaaggggggctgcctgaccgaggccacgaggagctgcggaagctggagagcacactggatggcctggagcgcagccgggagaggcaggaacgccgcatccaggtcacattaagaaaatgggagcgatttgaaacaaacaaagaaacagtagtaagatacctttttcaaacaggttccagtcatgaacgcttcttgagttttagcagtttggaaagtttatcttcagaactggaacaaacaaaggagttttctaaacggacagaaagtattgcagtccaggctgagaaccttgtaaaggaagcttcagagataccgcttgggccccaaaataagcagctgcttcaacagcaggccaagtcaatcaaagaacaagtcaaaaaattagaagacacgcttgaagaagagtatgtgattgacaagtcctaaactttcttctctgagataaagtttcatacaatctttcctgtaccttgtattcaaaacactcttttaaaatctcaaagtgtctgtgtatttcagcatgttttgaggaaacaactcacagttcaaaagaaagtatcgctaatacagaaaccaatatctataacagagcccaaaaaatataaaggatgtgggttttgcatcttaaactgatcatgttcatgagaaagccatatctattctattctgtggcctttgtacattgtagagggaatcttgaaaaagaactaatatttaaaataatttttttactatattattctgctgtcaccatttagagcgaaaaggagatattttgttagtgtagattccaggcctaaatacacatcacatagaccatatatctccaacctgaagaagctcctggagcttgtttacagtgcctcggtattcaagttatcctgactaatatgctctttccagaaattaactttaaaatattttatttttaaacttttaatgtttgtttatctgaaaaaaaaaaactgcttggcctattgatatcctgttatatacccaaaatatacaaaaaagtttggaggggaaaaacatatgaggatacagccaatattattcaaaacaatatggctaaacatttctatttttaacataatttagtggcaaatcaatgatacataatagcatattattattaagggacaggccatcatttctaaggtgggttttaaaatgtaaaatgtgtttttaatactattaacagcttaaaattaacattttacatttgcctaaactttaaaatttgatacatattttatttaaaacaaattatgacttgaaattttgaggactttatattacattaaatattctctatcaagttatggaaatagtaaaacagagtttattagaaaggaatttacttctattaagaatagccattttaacctttatttaatttaaaaagttgcaatataacacagcttgcattacctgtactgctgacagcattaggcacattcagggtataaatttgagactgcaatattatttaatttgacagtcaatgatgccactctatttttcttgatgtcttcaagtgccttttggtaaacagggacattctttcactttttttttttttaacccaaggacttactagttcaattatatactgttagtttcttagtctttttctaaactgaaagccatagtcacctggttatacatgcatagctaatacaaattagaaatctatagttgaaattctgttcactagatttgttacaaataaaacctataagttgtctaaaagtagttagggtgctcatgtacaataatttataaatgtcttttggaatcaggaccataagacatttatgaaaatggctgaagtcacaaagattatacatcgcaggattagctctaataatagaaacagttcttgcccggcagcatgggattgagatcacgagctctgtcttgattgataagatgcagtttataaaggtatttctatagaaagcatcactgcagtgtctctcctttaagtgtaagaagaacatttctttggaaataggactattgaaaagctgtgtacactgaaatcttttctggcatagtttataaaaataagtcctggcaacaactggtcacatgcagagtttaattagattctacctggattcaaacccctttggacccagcaatgttttgttcaaagtgcagtttcactcaaagtgtagatactgcctcattaaatgttcattctcagagaagataggaaaacctgataaactactcagaacaactgtgcaattttttttttagcgtgaatagtttcaactttgaaatggtcacaaatgtcttcattatctcttcacctggtgatttcaaggaaaatgtgttgttgttctctattaaaatactgagttttatttacttaatttggttaattttagtattaaaaccatggaaatggtgaaaaccaagtgggatcattttggcagtaattttgagactctgtccgtctggataactgagaaagaaaaagaactcaatgccttggaaacttcgtcatctgccatggacatgcaaatcagccaaattaaggtgacctgctcacacattatatttataatccatgtctagcttttaagaactactttcttacatttcatcaaatgctgttcggtcccaggacaagactttcattgcaatgtgactattaaaattaaattcatacattttatcaagctaagaggtctggattaatactgggcaacatttatagttggaattatgtattcacattgtctgacttgtgcattcaaagttaatattgtgtgaaatatcattaaaatatttttatggttacattaa

SEQ ID NO: 185307 - DNA, 5837 bp, Homo sapiens
  Payload ID: 16494
  Gene Symbol: SYNE1
  Gene Name: spectrin repeat containing, nuclear envelope 1
  ENST ID: ENST00000367251
  CDS Start-End: 1-4965
gagaaaattgagcagaatggacttgctttgattcagaacaagaaagaagacgtctctagcattgtcatgagcacactgcgagagctcggccaaacctgggcaaatttagatcacatggttggacaattaaagatactgctgaaatcagtgcttgaccaatggagtagtcacaaagtggcctttgacaagataaacagttacctcatggaggccagatactctctttcccgattccgtctgctgactggctccttagaagctgtgcaagttcaggtggacaatcttcagaatctccaagatgatctggaaaaacaggaaaggagcttacagaaatttggctctatcaccaaccaattattaaaagagtgtcacccacccgtgacagaaactcttaccaatacactgaaagaagtcaacatgagatggaataacttgctggaagagattgctgagcagctacagtccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctcttttttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttggcttatcagatgtaatgatccccgaaagccctgaggcctatgtaaaactcacagaaaatgcaatcaaaaatacctccggggaccacagtgccctagagtcacagatccgacaactgggcaaagccctggatgatagccgttttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaaa

SEQ ID NO: 185308 - DNA, 5189 bp, Homo sapiens
  Payload ID: 16494
  Gene Symbol: SYNE1
  Gene Name: spectrin repeat containing, nuclear envelope 1
  Uniprot ID: Q8NF91
  ENST ID: ENST00000367253
  CDS Start-End: 1-5178
atggcaacctccagaggggcctcccggtgtcctcgggatatcgccaatgtgatgcagaggctgcaagatgagcaagagatagtacaaaaacgaactttcacaaaatggatcaactctcatctggccaagcggaaacctccaatggtggtggacgatctttttgaagacatgaaagatggtgttaaactgcttgcccttctggaggtcctgtctgggcagaaactgccttgtgaacaaggacgccggatgaagcgaatccatgctgtggctaacattggcacggcactcaagttcctcgaaggaagaaagattaaattagtcaacattaactccaccgatatagctgatggccgaccctcaatagttcttggattgatgtggaccattattctatatttccagattgaagagttgaccagcaacctgccccagctccagtctttgtccagcagcgcatcctccgtggacagcatagttagctctgagactcccagcccaccaagtaaacggaaggtgaccaccaagatccaaggaaatgctaagaaggctttattaaagtgggttcagtacacagctggcaagcagactggaatagaagtaaaagattttgggaagagttggagaagcggggttgcctttcattcagttattcatgccattcgaccggaattggtggacttggagacagtgaaaggcagatccaaccgagaaaatttggaggatgctttcactatcgccgaaacagaactggggatcccaagactgctagatcctgaagacgttgatgtggataaaccagatgagaaatctattatgacctatgtagcccagtttctgaaacattatcctgacatccacaatgcaagcactgatgggcaagaggatgatgaaatacttccaggtttcccatcttttgcaaattctgtacaaaattttaagagagaagacagagtaatttttaaggaaatgaaagtttggatagaacaatttgagagagatttgacaagagcacagatggtggaatcaaatttacaggataaatatcagtcatttaagcacttcagagttcaatatgaaatgaagaggaaacagattgaacatttaatacaaccattacacagagacggtaaattgtcacttgaccaagcattggtaaaacaatcttgggatagagtgacctccaggctctttgactggcatatacagcttgataaatctcttcctgcacctctgggcaccataggtgcctggctgtacagagcggaggtggccctgagagaggaaataaccgttcaacaggtccacgaggaaacagcaaacacgatacaacggaaacttgagcaacataaggatctgcttcaaaacacggatgcccacaaaagagcattccatgaaatctaccggaccaggtctgttaacgggattccagtgccacctgatcaattagaggacatggccgagaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctgaaaaaatgctcaatcaatcagaaaatgccaaaaaggatttttttcgaaatttacctcattggattcagcagcatactgccatgaacgatgctggcaattttctaattgaaacctgtgatgagatggtttcccgtgacctgaagcagcaattactgttgctaaatgggcggtggagggagttgtttatggaagtcaagcaatatgctcaagctgatgagatggacagaatgaagaaggaatacacagactgtgttgttaccctgtctgcttttgcaacggaagcccataagaaactttctgaacccttagaagtctcttttatgaatgtcaagctattaattcaagacttggaggatattgagcagagggtgcctgtgatggatgcccaatacaagataattacaaagacagcacacctcattaccaaagaaagcccccaagaagaaggaaaagaaatgtttgcgaccatgtcaaagctcaaagagcagctaaccaaggtcaaagaatgttactccccactcctttatgagtctcagcagctgttgattccgttggaggaattagaaaagcagatgacgtccttttatgactcacttgggaaaatcaatgaaattatcacagttcttgagcgtgaggcacaatcgagtgccctttttaaacaaaaacatcaggaactgttagcttgtcaagaaaactgtaagaaaaccttgacacttattgagaaaggcagtcaaagtgttcaaaagtttgtgaccttgagcaacgtgttaaagcattttgatcagacgaggctacaaagacagattgcagatattcatgttgcttttcagagtatggtaaagaaaactggagattggaagaagcatgtggaaaccaacagtcgcttgatgaagaagtttgaggagtctcgagcagagttggagaaggtactgcggattgctcaggagggcctggaggaaaagggggatccagaggagctcctgcggagacacactgagtttttcagtcagctggatcagagggtgctcaatgctttcctgaaagcttgtgatgaactcaccgacatccttccagagcaggagcagcaggggctgcaggaagctgttcgaaagctccacaaacaatggaaggatcttcaaggagaagccccttatcatttgcttcatctgaagattgatgtggagaagaataggttcttagcctctgtagaagaatgcagaactgagctggatcgagagaccaagctgatgccccaggaaggcagtgaaaagataattaaagagcacagggttttcttcagtgacaaaggtcctcatcatctctgtgagaaaaggttacagctcatcgaggaactctgtgtgaaactcccagtgcgggacccagtaagggacacacctggaacctgtcacgtgactctcaaagagctcagagctgccattgacagcacctacaggaagctcatggaagacccagacaagtggaaggactacactagcagattctctgagttctcatcttggatatctacaaatgagacacaattaaaggggatcaagggtgaggccatcgatactgccaaccacggagaggttaaacgtgccgttgaagagatcagaaatggtgttaccaaaaggggtgagaccctcagctggctgaaatccaggctgaaagttttgacagaagtttcttctgagaatgaagcccaaaagcagggagatgagctggcaaaattatccagctctttcaaggctcttgtgacgctgctgtcagaggttgaaaagatgctaagcaattttggggactgtgtccagtacaaagaaatagtcaaaaattctctcgaagaattaatttctggctctaaagaagtccaggaacaagctgagaagatcttggatactgaaaatctgtttgaagcacagcagttacttcttcatcaccagcaaaagacaaagcggatctcagcaaagaagagagatgtgcagcagcagatcgcgcaggcgcagcagggagaaggggggctgcctgaccgaggccacgaggagctgcggaagctggagagcacactggatggcctggagcgcagccgggagaggcaggaacgccgcatccaggtcacattaagaaaatgggagcgatttgaaacaaacaaagaaacagtagtaagatacctttttcaaacaggttccagtcatgaacgcttcttgagttttagcagtttggaaagtttatcttcagaactggaacaaacaaaggagttttctaaacggacagaaagtattgcagtccaggctgagaaccttgtaaaggaagcttcagagataccgcttgggccccaaaataagcagctgcttcaacagcaggccaagtcaatcaaagaacaagtcaaaaaattagaagacacgcttgaagaagatattaaaaccatggaaatggtgaaaaccaagtgggatcattttggcagtaattttgagactctgtccgtctggataactgagaaagaaaaagaactcaatgccttggaaacttcgtcatctgccatggacatgcaaatcagccaaattaaggtcacaattcaggaaatagaaagtaagctcagcagcattgtaggattagaagaagaagcccagtcttttgctcagtttgttaccactggagaatctgctcgaattaaagccaagttgacacaaataagaagatacggggaagagcttcgagagcatgcacagtgtctggaaggaacaatcctgggacatttatctcagcagcaaaagtttgaagagaaccttagaaagatccagcaatctgtgtctgaatttgaagataaacttgctgttccaattaaaatatgttcttcagctacagaaacatacaaagttcttcaagaacatatggatctctgccaggccctggagtcactgagcagcgcgatcactgccttctcagccagtgccaggaaggttgtgaacagagattcctgtgttcaggaggctgcggctctacagcagcaatacgaggacatcctaaggagggcgaaggagagacagacggcgctggagaatctgctggcccactggcagaggctagagaaagaactatcatcctttttgacctggttagagcggggtgaagctaaagccagttccccagaaatggacatttctgcagacagagtcaaagtggaaggtgaacttcagttaatacaggcaagttcaaggaagtgtgaggaaggaaaaaataaaatgctttttgttacagttacattatttaaaataataaaataaataaacttgta

SEQ ID NO: 185309 - DNA, 27748 bp, Homo sapiens
  Payload ID: 16494
  Gene Symbol: SYNE1
  Gene Name: spectrin repeat containing, nuclear envelope 1
  Uniprot ID: Q8NF91
  ENST ID: ENST00000367255
  CDS Start-End: 603-26996
cccgggcagtggaaaccgtgggcaaaagttagctggcaggacagcgcagctcctccaggcagcggaggcagcgcgtcccggctctcagggacatttccttcccacctcgacccccgggaggtggtcccggtataaaggctcgctgagcgggtgggtcacagcacagctttgcagctgcggagaaacgcccaaggccgtgcatctccaggagggcggctgggctcccgcagtcctgcagaccgcgcccgatcccggcgacagggcgggcggacagccgcgcatccccggggtcccgccgagcctgggcgcagagagccgggaggaagcgttcgctcgcttcgccttgctgctgggaaactgaacgaggccgagagagaaggttcttgagttcatgtaagaggacagtcttaaaacggaagaagaaaaagaagcagttcagtctttgggagagctgcctccttgttgagtgctgcaaaggcctggaattcatttatgacagaatagatctagaaaagtccaagcatgttttctagagtggtgtagccctgtgctgcctccagtgaagagtctcttggtgttggcttcgtgcttccggagggaccatggcaacctccagaggggcctcccggtgtcctcgggatatcgccaatgtgatgcagaggctgcaagatgagcaagagatagtacaaaaacgaactttcacaaaatggatcaactctcatctggccaagcggaaacctccaatggtggtggacgatctttttgaagacatgaaagatggtgttaaactgcttgcccttctggaggtcctgtctgggcagaaactgccttgtgaacaaggacgccggatgaagcgaatccatgctgtggctaacattggcacggcactcaagttcctcgaaggaagaaagattaaattagtcaacattaactccaccgatatagctgatggccgaccctcaatagttcttggattgatgtggaccattattctatatttccagattgaagagttgaccagcaacctgccccagctccagtctttgtccagcagcgcatcctccgtggacagcatagttagctctgagactcccagcccaccaagtaaacggaaggtgaccaccaagatccaaggaaatgctaagaaggctttattaaagtgggttcagtacacagctggcaagcagactggaatagaagtaaaagattttgggaagagttggagaagcggggttgcctttcattcagttattcatgccattcgaccggaattggtggacttggagacagtgaaaggcagatccaaccgagaaaatttggaggatgctttcactatcgccgaaacagaactggggatcccaagactgctagatcctgaagacgttgatgtggataaaccagatgagaaatctattatgacctatgtagcccagtttctgaaacattatcctgacatccacaatgcaagcactgatgggcaagaggatgatgaaatacttccaggtttcccatcttttgcaaattctgtacaaaattttaagagagaagacagagtaatttttaaggaaatgaaagtttggatagaacaatttgagagagatttgacaagagcacagatggtggaatcaaatttacaggataaatatcagtcatttaagcacttcagagttcaatatgaaatgaagaggaaacagattgaacatttaatacaaccattacacagagacggtaaattgtcacttgaccaagcattggtaaaacaatcttgggatagagtgacctccaggctctttgactggcatatacagcttgataaatctcttcctgcacctctgggcaccataggtgcctggctgtacagagcggaggtggccctgagagaggaaataaccgttcaacaggtccacgaggaaacagcaaacacgatacaacggaaacttgagcaacataaggatctgcttcaaaacacggatgcccacaaaagagcattccatgaaatctaccggaccaggtctgttaacgggattccagtgccacctgatcaattagaggacatggccgagaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctgaaaaaatgctcaatcaatcagaaaatgccaaaaaggatttttttcgaaatttacctcattggattcagcagcatactgccatgaacgatgctggcaattttctaattgaaacctgtgatgagatggtttcccgtgacctgaagcagcaattactgttgctaaatgggcggtggagggagttgtttatggaagtcaagcaatatgctcaagctgatgagatggacagaatgaagaaggaatacacagactgtgttgttaccctgtctgcttttgcaacggaagcccataagaaactttctgaacccttagaagtctcttttatgaatgtcaagctattaattcaagacttggaggatattgagcagagggtgcctgtgatggatgcccaatacaagataattacaaagacagcacacctcattaccaaagaaagcccccaagaagaaggaaaagaaatgtttgcgaccatgtcaaagctcaaagagcagctaaccaaggtcaaagaatgttactccccactcctttatgagtctcagcagctgttgattccgttggaggaattagaaaagcagatgacgtccttttatgactcacttgggaaaatcaatgaaattatcacagttcttgagcgtgaggcacaatcgagtgccctttttaaacaaaaacatcaggaactgttagcttgtcaagaaaactgtaagaaaaccttgacacttattgagaaaggcagtcaaagtgttcaaaagtttgtgaccttgagcaacgtgttaaagcattttgatcagacgaggctacaaagacagattgcagatattcatgttgcttttcagagtatggtaaagaaaactggagattggaagaagcatgtggaaaccaacagtcgcttgatgaagaagtttgaggagtctcgagcagagttggagaaggtactgcggattgctcaggagggcctggaggaaaagggggatccagaggagctcctgcggagacacactgagtttttcagtcagctggatcagagggtgctcaatgctttcctgaaagcttgtgatgaactcaccgacatccttccagagcaggagcagcaggggctgcaggaagctgttcgaaagctccacaaacaatggaaggatcttcaaggagaagccccttatcatttgcttcatctgaagattgatgtggagaagaataggttcttagcctctgtagaagaatgcagaactgagctggatcgagagaccaagctgatgccccaggaaggcagtgaaaagataattaaagagcacagggttttcttcagtgacaaaggtcctcatcatctctgtgagaaaaggttacagctcatcgaggaactctgtgtgaaactcccagtgcgggacccagtaagggacacacctggaacctgtcacgtgactctcaaagagctcagagctgccattgacagcacctacaggaagctcatggaagacccagacaagtggaaggactacactagcagattctctgagttctcatcttggatatctacaaatgagacacaattaaaggggatcaagggtgaggccatcgatactgccaaccacggagaggttaaacgtgccgttgaagagatcagaaatggtgttaccaaaaggggtgagaccctcagctggctgaaatccaggctgaaagttttgacagaagtttcttctgagaatgaagcccaaaagcagggagatgagctggcaaaattatccagctctttcaaggctcttgtgacgctgctgtcagaggttgaaaagatgctaagcaattttggggactgtgtccagtacaaagaaatagtcaaaaattctctcgaagaattaatttctggctctaaagaagtccaggaacaagctgagaagatcttggatactgaaaatctgtttgaagcacagcagttacttcttcatcaccagcaaaagacaaagcggatctcagcaaagaagagagatgtgcagcagcagatcgcgcaggcgcagcagggagaaggggggctgcctgaccgaggccacgaggagctgcggaagctggagagcacactggatggcctggagcgcagccgggagaggcaggaacgccgcatccaggtcacattaagaaaatgggagcgatttgaaacaaacaaagaaacagtagtaagatacctttttcaaacaggttccagtcatgaacgcttcttgagttttagcagtttggaaagtttatcttcagaactggaacaaacaaaggagttttctaaacggacagaaagtattgcagtccaggctgagaaccttgtaaaggaagcttcagagataccgcttgggccccaaaataagcagctgcttcaacagcaggccaagtcaatcaaagaacaagtcaaaaaattagaagacacgcttgaagaagatattaaaaccatggaaatggtgaaaaccaagtgggatcattttggcagtaattttgagactctgtccgtctggataactgagaaagaaaaagaactcaatgccttggaaacttcgtcatctgccatggacatgcaaatcagccaaattaaggtcacaattcaggaaatagaaagtaagctcagcagcattgtaggattagaagaagaagcccagtcttttgctcagtttgttaccactggagaatctgctcgaattaaagccaagttgacacaaataagaagatacggggaagagcttcgagagcatgcacagtgtctggaaggaacaatcctgggacatttatctcagcagcaaaagtttgaagagaaccttagaaagatccagcaatctgtgtctgaatttgaagataaacttgctgttccaattaaaatatgttcttcagctacagaaacatacaaagttcttcaagaacatatggatctctgccaggccctggagtcactgagcagcgcgatcactgccttctcagccagtgccaggaaggttgtgaacagagattcctgtgttcaggaggctgcggctctacagcagcaatacgaggacatcctaaggagggcgaaggagagacagacggcgctggagaatctgctggcccactggcagaggctagagaaagaactatcatcctttttgacctggttagagcggggtgaagctaaagccagttccccagaaatggacatttctgcagacagagtcaaagtggaaggtgaacttcagttaatacaggcactgcaaaatgaagttgtatcccaggcctcattctatagcaaacttttgcaattgaaggaatcattgttctcagtagcctccaaagatgatgtgaaaatgatgaaactacatttggagcagttggatgagagatggagagatttaccacagatcattaacaaaaggattaattttcttcagtctgtggttgctgaacaccagcaatttgatgagctgctgctttccttttctgtctggattaaactgtttctcagtgaattacaaactacctctgagattagcataatggaccatcaagtagcccttactcggcataaggaccacgcagcagaagtagagagcaaaaagggcgaattgcagagtctgcagggtcacttagcaaagttgggttctctgggccgtgctgaggacctccacctcctgcagggaaaggctgaggactgcttccagctgtttgaggaggccagccaggttgtggagaggcggcagcttgccctgtcccatttggcagaattcctccagagccatgcctctctgtccggcattctccgccagctgaggcaaacagtggaagcaaccaacagtatgaataagaacgagtctgatttgatagaaaaggacctcaatgatgctcttcaaaatgctaaagcattagaatctgctgccgtcagtctggatggcattctttccaaagcccaataccatctgaaaatcgggagctctgagcaaaggacttcctgcagagccacggctgatcagctctgtggagaggtagagaggatccagaaccttctgggaaccaagcagagtgaggcagatgctctggcagtgttgaaaaaagcattccaagaccagaaagaggagcttctgaaaagcattgaggacattgaagaaaggactgacaaagagcgattgaaagaacctacccgccaagctcttcagcagaggttaagagtgtttaatcagctagaagatgaattgaattctcacgagcatgaactatgttggttgaaagacaaagccaagcaaattgcccagaaagatgtagcttttgcacctgaagttgacagggagataaaccgcttagaggtcacctgggatgataccaaaagactaattcatgaaaatcagggtcagtgctgtggacttattgacttaatgagagaatatcagaacctgaaatcagctgtatctaaagtcttagaaaatgccagcagtgtgattgtaaccagaactaccataaaagatcaggaggatcttaaatgggctttttccaagcatgaaactgccaagaacaaaatgaattacaaacagaaagacttggataactttaccagcaaaggaaaacacttgttatctgagctgaagaaaattcacagtagtgatttcagcttggtgaaaacagacatggagagcaccgtggacaaatggctggatgtatcagagaaacttgaagaaaacatggataggctgagagtaagcctgtccatttgggatgatgtactgtcaactagagatgagattgagggatggtcaaacaactgcgttccacagatggcagaaaacatcagcaacctggataaccacctcagagctgaagaactgcttaaagaatttgagtctgaagttaaaaacaaagcattgagattggaagaactgcattccaaagttaatgatctgaaagaattaactaaaaatctagaaacaccgccagaccttcagtttatagaagcagacttaatgcagaaactggagcatgccaaagaaataactgaagtagcaaaaggaaccctgaaggatttcacggctcaaagtacacaagtggagaagtttattaatgacataacaacatggttcacaaaagtggaagaatcgttgatgaactgtgcccaaaatgagacttgtgaagcattgaaaaaagtcaaggatatacaaaaagaacttcaaagtcaacaaagcaacatcagctctacccaagaaaatctcaatagcttgtgccgcaagtaccactcagctgagttggagagcctgggccgtgcaatgactggtctgataaagaaacatgaagccgtgagccagttgtgctccaaaacccaggccagcctgcaggaatctctggaaaaacacttcagtgagtctatgcaggaattccaagaatggtttttgggagcaaaggcagcagcaaaagaatcatcagatcgcaccggtgacagcaaagttctagaagcaaagctccatgatcttcagaacattttggactcagtcagtgatgggcagagcaaacttgatgcagtgactcaagaaggacaaactttgtatgcacatttgtctaaacaaattgtcagtagcattcaagaacaaatcacaaaggccaatgaagagtttcaagcatttctgaaacaatgccttaaagataagcaggctcttcaagactgtgcttcagaacttggaagctttgaagatcagcacagaaaactgaacttatggatccatgaaatggaagaaaggttcaatacggaaaacttgggagagagtaaacagcacattcctgagaagaaaaatgaagttcataaagttgaaatgtttttgggagaactgctggctgcaagagagtctcttgataagctttcccagagagggcagcttctgagtgaagaaggccacggtgctgggcaggagggccgcctgtgttcccagctcctcacaagccaccagaacctacttagaatgaccaaagagaaactccggagctgccaggtggcccttcaggagcacgaagccctggaggaagcactgcaaagcatgtggttctgggtgaaggccattcaggacagactggcctgtgcagagagcactcttgggagcaaagacaccctggagaaacggctgtcacaaatacaggatattctcctgatgaaaggtgaaggggaagttaagttgaatatggccattggcaagggggaacaggccttgagaagtagcaacaaagaaggtcagagggtgattcagactcagttagagacccttaaagaagtgtgggctgacatcatgagctcctccgtccacgctcaaagcactttagagtctgtgattagccaatggaatgactatgtagagaggaaaaaccagttggagcagtggatggaatcagtggatcaaaaaatagaacatcccttacaaccacagccaggtctgaaagagaagttcgtcctgcttgaccacctccagtccatcctgtctgaggcagaagatcacacgagagcccttcaccgtctaattgcgaagtccagggagctctacgaaaagacagaggatgagtctttcaaggacacagctcaagaggagctgaaaacacagtttaatgatataatgactgttgccaaggaaaaaatgaggaaagtggaagagattgtgaaagatcatctaatgtatttagatgcggtccacgagttcacagattggctccattcagcaaaggaagaacttcaccggtggtcagatatgtctggagattcatcagccacccagaaaaagttatcaaaaattaaggagctgatagattccagagagattggtgcaagccgtctcagcagagtggagtcgctggctcccgaagtgaaacagaacacaactgccagtgggtgtgagctcatgcacacggagatgcaggccctgcgtgccgactggaagcagtgggaagacagtgtattccaaacgcagagctgtttggagaacctggtcagccagatggccctttcggagcaggaattctcaggccaagtggctcaactggagcaggccctggaacagttcagtgcccttctgaaaacctgggctcagcagttaaccctcctggaaggcaagaacacggatgaggagatagtggaatgctggcacaaaggacaagagatactggatgctttgcaaaaagcagagcctagaacagaggatctcaagtctcagctgaatgaactttgtcgattttccagagacctgagtacctacagtggaaaagtttctggcttgattaaagagtataattgtctttgtttgcaagcatccaagggctgccagaataaagaacagattttacagcaaagatttcgaaaggccttcagggatttccagcagtggttggttaatgcaaaaatcactaccgccaagtgttttgatatacctcaaaatataagtgaagtttcaactagtcttcagaaaatacaggagtttttgtcagaaagtgaaaatggacagcacaagctaaacatgatgctgtctaaaggggaacttctgagtaccctgctgaccaaagagaaagcgaaagggatccaggccaaagttacagctgcaaaagaagattggaaaaattttcattcaaatctccaccaaaaagaatctgctctagagaatctaaagatccaaatgaaggactttgaagtaagtgctgagcctatccaggactggctgagtaaaactgagaagatggtccatgaaagcagcaatcgcctctatgatctgccagcaaagaggagggagcagcagaagctccagtctgtccttgaggaaatacactgctacgagcctcagctcaacaggctgaaagagaaagctcagcagctgtgggaaggacaagctgccagcaagagctttaggcacagagtgtcgcagctgtcttctcagtatctagcgctaagcaatttaacaaaggagaaagtgtcaagactggatagaatcgttgcagaacacaatcagttctctcttgggattaaagaattacaagactggatgacggatgcgattcacatgctggattcatactgccacccgacatccgacaaaagtgtgctggacagcaggacgctcaagctcgaggctctattatcagtcaaacaggaaaaagagattcagatgaaaatgatagtgaccaggggagaatctgtccttcagaatacttctccagaaggcattcccactattcagcagcagctgcagagtgtgaaggatatgtgggcatcccttttgtctgcagggattcgttgtaaaagccaactcgaaggagctctctccaagtggacaagttatcaggatggcgttcgacagttctccggttggatggatagtatggaagccaacctgaatgaatcagaaaggcagcatgcggagctgcgggataaaacaacgatgctcggaaaagccaagttattaaatgaagaagtgctgagttacagcagcttgctggagaccatcgaagtcaaaggggctggcatgacagaacactatgtcacccagctagaactccaggatctacaggaacgatacagagccatccaagagagggccaaggaagccgtaaccaagtctgaaaaacttgtccgcctgcaccaagagtatcagagagacctaaaggcatttgaagtttggttggggcaagaacaagaaaagctcgaccagtattcagttcttgaaggtgatgcccacactcatgagacaacattgcgtgatcttcaggagctacaggtacactgtgcagaggggcaggccctgttgaactcagtgctgcacaccagagaggatgtgatcccatcaggtatcccacaggcagaggaccgggctttagagtctctccggcaagactggcaggcttaccagcacaggctgtccgagactcgaactcagttcaataacgtggtgaacaaattgaggctaatggagcaaaagtttcagcaagtagatgaatggctcaaaacagcagaggagaaagttagtcccaggaccagacgtcagtctaacagggcaaccaaggagatacaattacatcagatgaagaagtggcacgaagaagtgactgcatacagagatgaagttgaggaagtgggagctagagctcaggagatactggacgagagccacgtgaacagcagaatgggttgccaggccacccagctgacttccagataccaggccctgcttctccaagtgctggaacaaataaaattcctggaggaggagattcagagtttggaggaatcagaatcatccctcagttcctattctgattggtatggctctactcataaaaacttcaagaatgtggctaccaagattgacaaagtagatacagtaatgatggggaagaaattgaagacgttggaggttttgctcaaagacatggagaaaggtcacagtttgctgaaatcagcccgggagaaaggagagagggctgttaaatacttggaggaaggcgaggcagagaggttaagaaaggagattcatgatcacatggagcagttgaaggaactgaccagcactgtccggaaagaacacatgacgctggaaaaaggtcttcatttagcaaaggaattctcagataaatgcaaagcactgacacagtggatagcagaataccaggaaattctacatgttcctgaagaacccaaaatggaattatatgagaaaaaagctcagttatctaaatacaagtcacttcaacaaacggtgctgtcccatgaaccatcagtaaagtcagtgagagagaagggtgaagctcttttggaactggtgcaggacgtcactttaaaggacaaaatagatcaacttcaaagtgattaccaggacctgtgcagcataggaaaggagcatgtcttcagtctggaggcgaaagtcaaagaccatgaagactacaacagtgagctccaagaggtcgaaaagtggctgctgcagatgtctggcagactggtggcacctgacctcctggagacaagcagcctggagacaatcacccagcaattggcccaccacaaggcaatgatggaagaaattgctggttttgaagaccgtttgaacaatcttcaaatgaaaggtgatactttgattggccaatgtgcagaccacctgcaagcgaaacttaaacaaaacgtgcatgctcatctgcagggcacaaaggacagctactcagcgatctgcagcacagctcagaggatgtaccagagtttggaacacgaacttcagaagcacgtcagccgacaagacaccctgcagcagtgccaggcctggctttctgcagtccagccggatttagagccaagtcctcaaccacctcttagtagggcagaagccattaagcaggtcaaacacttcagagctttgcaagagcaggcaaggacctacctagatctcctttgctccatgtgtgacctgtcaaatgcttcggtgaaaaccacagcaaaagacattcaacaaacagagcaaacgattgaacaaaagcttgtccaggcccagaacttaactcagggctgggaagagatcaagcacctgaagtctgagctctggatttacctgcaagatgctgatcagcaactgcagaacatgaagaggaggcactctgagctggagctgaacattgcacagaacatggtttcacaagttaaggattttgttaagaaactacagagcaaacaggcatccgtgaacaccataatagaaaaggtgaataagttaacaaagaaggaggaatcgcctgaacacaaggaaataaatcatttaaatgatcagtggctcgatttgtgccgtcagtctaacaacctgtgcttgcaaagggaagaggatcttcagagaacaagagattaccatgactgtatgaatgttgttgaagtgttcctagaaaaatttactacagaatgggataacttggccagatctgatgcagagagtacagctgtccacctggaagctttgaaaaagttagcattggcattgcaggagagaaagtatgctattgaagatctgaaagatcaaaagcagaaaatgatagagcatctgaatttagatgacaaggagttagtcaaagaacagacgagtcatttagagcaacgttggtttcagcttgaggacctcattaaaaggaaaatccaagtgtcagtcaccaacttggaggagttaaatgtggtgcagtccagatttcaggagctaatggagtgggcagaagagcaacaacccaacatcgccgaggcccttaagcagagccctcctccagatatggctcagaaccttctcatggatcacctggccatctgcagtgaactggaggccaagcagatgctcctgaaatcgcttataaaggacgcagacagggtcatggcagatcttggtctcaatgagcgacaggtcatccagaaggctctctctgatgcacaaagccacgtgaattgtctcagtgacttagtgggccagcgaagaaagtacttaaacaaagccttgtccgagaaaacccagtttctcatggcagtgttccaggccaccagccaaattcagcaacatgagcgaaagataatgttccgtgaacacatctgtctgttaccagatgatgtgagcaaacaagtcaaaacatgtaagagtgcacaagccagcctcaagacttaccaaaatgaagtcactggactttgggcccagggtcgcgaactaatgaaggaagtcacagagcaggaaaagagtgaagtgctggggaagcttcaggaattgcagagtgtctatgacagtgttttacaaaagtgcagtcaccggttacaagaactagagaagaatttggtttctaggaagcattttaaggaagattttgataaagcttgccactggctaaaacaagcagatattgttacatttcctgaaatcaacctaatgaatgagagttctgagcttcatacacaactggctaaataccaaaacattcttgaacaatctccagaatatgaaaatcttctacttacgctgcagagaactgggcagaccatattaccatcgctgaatgaagtcgatcattcctacctcagtgaaaagctaaatgctttgcctcgacaatttaatgtaattgttgccttggctaaagacaagttctataaagtccaggaagcaattcttgctcggaaggaatatgcttccttgattgagttgacaacccagtctctgagtgaacttgaagcccaattcttgaggatgagcaaagttcccaccgacctggccgttgaggaggctctttctctgcaagatggttgcagagccattctggacgaggtggcgggccttggggaggcggtggatgaactgaaccagaaaaaagaaggttttcgcagcacaggtcagccttggcagccagacaagatgctgcaccttgtcaccttatatcacaggctgaagcgacaaacagaacagagggttagcttattagaagacaccaccagtgcttaccaagaacacgagaagatgtgccaacagctggagagacaactgaagtctgtaaaagaggagcagtccaaagtgaatgaggaaacgctgcctgcagaggagaagctcaaaatgtatcactccctggcaggaagtctccaggactcagggattgtactgaaacgagtaaccatacatcttgaagatcttgccccacaccttgaccccttggcttatgagaaagccaggcatcagatccagtcctggcaaggggagttaaaactgttgacttctgccattggtgagacggtgacagaatgtgagagccgaatggtgcagagtatagacttccagactgagatgagtcgctccctggactggctgaggagagtgaaggcagagctcagtgggccggtgtacctagacctcaacctgcaggacatccaagaggaaatcagaaaaatccaaattcatcaggaagaggtccagtccagcttgagaatcatgaatgcgctgagtcacaaggaaaaggagaagttcacaaaggccaaggagctgatttctgcggatttagaacacagcctcgctgagctctcagagctggatggagacatccaggaagccttacgcaccagacaggctaccttgactgaaatatatagccagtgtcaaaggtattatcaggtatttcaagcagccaatgactggcttgaggatgcccaagaattgttacagctggcaggcaatggcctagacgtggagagcgcagaggaaaatctcaaaagccacatggaatttttcagtacagaggatcagttccatagtaacctggaggagctccacagcctggtagccaccctggacccactcatcaagccaaccggcaaagaagacctagaacagaaagtggcttctctggaactcaggagccagaggatgagccgggactctggtgcccaagtggatctcttgcagagatgcacagctcaatggcacgattaccagaaagcaagggaagaggttattgaattgatgaatgatacagaaaagaaattgtctgagttttctttgttgaagacttcgtctagtcatgaagcggaagaaaaattgtcagaacacaaggctttagtgtcagtggttaactctttccatgagaaaattgtggcccttgaggaaaaagcttcacaactggagaaaaccggaaatgatgccagcaaagccaccctgagcaggtcaatgaccaccgtctggcagcgctggacacgccttcgagctgtggcccaggaccaggagaagatcctggaagatgcagtggatgagtggacgggctttaacaacaaggttaaaaaggccactgaaatgattgatcagctgcaagataagttacctggaagttcagcagagaaagcatcgaaagcagagctcttaactcttcttgaataccacgacacgttcgttctggagctggagcagcagcagtcggccttgggcatgctgcggcagcaaaccctgagcatgctccaggatggagccgccccaacccctggggaagagcctccgctcatgcaggaaatcaccgccatgcaagatcggtgcctgaacatgcaggagaaagtgaagactaatggaaagttggtgaagcaagagctgaaggaccgagaaatggtggagactcagatcaattctgtgaaatgttgggttcaggaaacgaaagaatatttagggaatccaacaatagaaatagatgctcaacttgaagaacttcagattctcctaacagaagccacaaatcaccgacagaacattgaaaaaatggcagaagaacagaaggagaagtacttaggtctttataccatattaccttctgaactctcccttcagttggctgaagtggcgttagatctaaagatccgagatcagatccaagacaaaataaaagaagttgagcagagcaaggccacgagccaggaactcagccggcaaattcagaagttagctaaagacctcacaactattctaactaagctgaaagcgaagacagataatgtagttcaagctaaaactgaccaaaaggtgctgggagaggaattagatggctgtaattcaaagttaatggaattagatgcagcagtacagaaattcttggaacagaatggccaactgggtaagccactggccaagaagataggaaaactgactgaacttcaccagcagaccattagacaagctgagaatcggctctccaagctcaatcaggcagcatcacatttagaagaatacaatgaaatgcttgaattaattttgaagtggattgaaaaagctaaagtcttggctcatggaactattgcatggaattctgcaagccagcttcgggaacaatatattttgcatcagaccctgctagaagaatccaaagaaattgacagtgagctggaagcaatgactgagaaattacagtacctcactagcgtgtactgtacagaaaaaatgtctcagcaagtggcagaactgggacgggagactgaggagttgcgacagatgatcaaaattcgtttgcagaacctccaagatgcagctaaggatatgaaaaaatttgaagcagagttgaaaaagttacaagctgccttggagcaagcccaggcaacactgacttctccagaagttggacgtctcagtctcaaggagcagctctctcatcggcagcatttgttgtctgagatggagtcactgaagccgaaggtgcaagcagtgcagctctgccagagtgccctccggatccccgaggatgtggttgccagcttacctctctgtcatgctgctctgcggctgcaggaagaggccagccggctgcagcacaccgccatccagcagtgtaacatcatgcaggaagctgtggtacaatatgaacaatatgagcaagaaatgaaacatctccagcaactgatagaaggagctcacagagagattgaggataaacctgttgccaccagtaacatacaggagctgcaggctcagatttctcggcatgaggagctggcgcagaaaattaagggctaccaggagcagatcgcttctttgaattccaagtgcaagatgctgacgatgaaagccaagcacgccaccatgctgctgacggtgaccgaggtcgaggggctggcggaagggacagaggacctggatggggagctcctccccacgccttcggcccacccctctgtggtcatgatgactgcaggtcgctgtcacactttgctgtcaccggtcactgaggagtctggggaggagggaaccaacagtgagatttcctctccacctgcctgtcgctccccttcacctgtggctaatacagatgcttctgttaaccaggacattgcatattaccaagccttgtctgctgagaggttgcagacagatgctgcaaaaattcaccccagcacatccgcatcccaggagttctatgaaccgggattggagccatccgctactgccaaactgggtgatttgcagcgttcttgggaaaccttaaagaatgtgatcagtgagaagcagcgcacactctatgaagctttggaacgccagcagaagtaccaggactccctccagtccatctctacgaagatggaggccattgagctgaaactcagtgagagcccagagcctggcaggagtccagaaagccagatggctgaacatcaggcattgatggatgagattctcatgctccaggatgaaatcaatgagctccagtcctctctcgcagaggagctggtatccgagtcttgtgaggccgaccctgcggagcagctggccttgcagtccacgctcactgtcttagccgagcgaatgtccaccatcaggatgaaagcctcggggaaacggcagcttttggaggagaagttgaatgatcagctggaggaacaaaggcaggaacaggccctgcagaggtatcgctgtgaagccgatgagctggacagctggctcttgagtaccaaggccactctggacactgcgctgagtccacccaaggagcccatggacatggaggcccagcttatggactgccagaatatgctggtggaaatagagcagaaggtggtggctttatcagaactgtcagtccacaatgagaacctgctgctggagggcaaagctcacaccaaggacgaggccgagcagctggctggaaagctgagaaggctcaaggggagcctgctggagctgcagagagccctgcatgataagcagctcaacatgcagggaacagcacaggagaaggaggagagcgatgttgacctaacagccacgcagagccccggcgtccaggaatggctggcccaagctcgcaccacatggacccagcagcggcagagcagtctccagcaacaaaaagagttagaacaggaattagccgagcagaagagtctccttcgctcagtagccagtcgtggagaggagattctaattcaacattcggcggcagagacctctggtgatgctggcgaaaaacctgatgtgttatcccaggagttggggatggaaggggagaaatcatccgctgaagaccagatgagaatgaaatgggaaagcctacatcaagaatttagtaccaagcagaaactactacagaatgttctggaacaggaacaagagcaagtgctttatagcaggccaaatcgactcttgtctggtgtgccactgtacaaaggggacgtgccaacccaagataaatctgcagttacatctttgctggatggactgaaccaagccttcgaggaggtttcatcccagagtggaggggcaaagaggcagagtatacacttggagcagaagttgtatgatggagtctcagccacctctacttggttggatgacgttgaagaacgtttatttgttgccacagcacttttaccagaagaaacagagacttgtctcttcaaccaagagattcttgccaaagacattaaggaaatgtctgaagaaatggataagaacaaaaacttgttttcccaagcttttccagagaatggtgataatcgagatgttattgaagatactttgggttgtcttttgggcaggttatccttgctagactcagtagtgaatcaacgatgtcatcagatgaaagaaagacttcagcaaatactaaatttccagaatgatctgaaagtgctgtttacatcactggctgacaacaaatacatcattctgcaaaaactggcaaatgtgtttgaacagcccgtagcagaacaaatagaggcaatacaacaggctgaagatggactcaaagaatttgatgcaggaatcattgaattaaagaggcgtggtgacaagctacaggtcgagcagccgtccatgcaagaactctccaagctccaggacatgtatgatgagctgatgatgatcattggctcccggaggagtggtctgaatcagaaccttacactcaagagtcagtatgagagggccctacaagatctggctgacctgctagaaactggtcaggagaagatggcaggagaccagaaaatcatcgtgtcttccaaagaggaaatccagcaactacttgacaaacataaggaatactttcagggcctggaatctcatatgatcttgactgaaacactcttcagaaagataatcagctttgcagtccaaaaggaaacccagttccatacagagctgatggctcaggcttctgctgtactgaaacgggctcacaagaggggtgtggagctggagtacattctagagacgtggtcccatctggatgaggaccagcaggagctcagcagacagctggaggtggtggaaagcagcatcccaagcgtgggtctggtggaggagaacgaggacaggcttattgaccgcataacactctaccagcatttaaaatctagccttaatgaataccagcccaaattatatcaagtattagatgatgggaaacgacttctgatatccatcagctgctcagatctagaaagccaactaaatcaacttggagagtgctggctaagtaacaccaataaaatgtctaaggaacttcacagactggaaacaatattgaaacactggaccagatatcaaagtgaatctgcagatctaattcactggttacaatctgcaaaagaccggctagaattttggactcagcaatctgtgacagtcccacaagagctggaaatggtccgtgatcatctaaatgctttcctggagttttctaaagaagtggatgcccaatcttccctgaaatcatctgttctgagtactggaaatcagctccttcgactaaaaaaggtggacacagccacgctgcgctctgagctgtcgcgcattgatagccagtggactgacctgctaaccaatatcccagccgtccaggagaagctccaccagctccagatggataaactgccttcccgccatgccatttctgaagtcatgagttggatttctctaatggaaaatgttattcagaaggatgaagataatattaaaaattccataggttacaaggcaattcatgaataccttcagaaatataagggttttaagatagacattaactgtaaacagctgacagtggattttgtgaaccagtccgtgctacaaatcagcagtcaggatgtggaaagtaagcgtagtgataagactgattttgctgagcaacttggagcaatgaataaaagttggcaaattctgcaaggtctagtaactgagaagatccagctgttggaaggcttattggaatcttggtcagaatatgaaaataatgtacaatgtctgaaaacatggtttgaaacccaggaaaagagactaaaacaacagcatcgaattggagatcaggcttctgttcaaaatgcactgaaagactgtcaggatctggaagatttgattaaagcaaaagaaaaagaagtagagaaaattgagcagaatggacttgctttgattcagaacaagaaagaagacgtctctagcattgtcatgagcacactgcgagagctcggccaaacctgggcaaatttagatcacatggttggacaattaaagatactgctgaaatcagtgcttgaccaatggagtagtcacaaagtggcctttgacaagataaacagttacctcatggaggccagatactctctttcccgattccgtctgctgactggctccttagaagctgtgcaagttcaggtggacaatcttcagaatctccaagatgatctggaaaaacaggaaaggagcttacagaaatttggctctatcaccaaccaattattaaaagagtgtcacccacccgtgacagaaactcttaccaatacactgaaagaagtcaacatgagatggaataacttgctggaagagattgctgagcagctacagtccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctcttttttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttggcttatcaggggaccacagtgccctagagtcacagatccgacaactgggcaaagccctggatgatagccgttttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaaagatatttatgtatgtacagtttgctaaagccaagttttgtttgtattgatttctttgcatttattatagatattataaaatagtt

SEQ ID NO: 185310 - DNA, 5022 bp, Homo sapiens
  Payload ID: 16494
  Gene Symbol: SYNE1
  Gene Name: spectrin repeat containing, nuclear envelope 1
  ENST ID: ENST00000367257
  CDS Start-End: 1-4068
gaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttggcttatcaggggaccacagtgccctagagtcacagatccgacaactgggcaaagccctggatgatagccgttttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaaagatatttatgtatgtacagtttgctaaagccaagttttgtttgtattgatttctttgcatttattatagatattataaaata

SEQ ID NO: 185311 - DNA, 1546 bp, Homo sapiens
  Payload ID: 16494
  Gene Symbol: SYNE1
  Gene Name: spectrin repeat containing, nuclear envelope 1
  ENST ID: ENST00000454018
  CDS Start-End: 1-1533
gagctgatagattccagagagattggtgcaagccgtctcagcagagtggagtcgctggctcccgaagtgaaacagaacacaactgccagtgggtgtgagctcatgcacacggagatgcaggccctgcgtgccgactggaagcagtgggaagacagtgtattccaaacgcagagctgtttggagaacctggtcagccagatggccctttcggagcaggaattctcaggccaagtggctcaactggagcaggccctggaacagttcagtgcccttctgaaaacctgggctcagcagttaaccctcctggaaggcaagaacacggatgaggagatagtggaatgctggcacaaaggacaagagatactggatgctttgcaaaaagcagagcctagaacagaggatctcaagtctcagctgaatgaactttgtcgattttccagagacctgagtacctacagtggaaaagtttctggcttgattaaagagtataattgtctttgtttgcaagcatccaagggctgccagaataaagaacagattttacagcaaagatttcgaaaggccttcagggatttccagcagtggttggttaatgcaaaaatcactaccgccaagtgttttgatatacctcaaaatataagtgaagtttcaactagtcttcagaaaatacaggagtttttgtcagaaagtgaaaatggacagcacaagctaaacatgatgctgtctaaaggggaacttctgagtaccctgctgaccaaagagaaagcgaaagggatccaggccaaagttacagctgcaaaagaagattggaaaaattttcattcaaatctccaccaaaaagaatctgctctagagaatctaaagatccaaatgaaggactttgaagtaagtgctgagcctatccaggactggctgagtaaaactgagaagatggtccatgaaagcagcaatcgcctctatgatctgccagcaaagaggagggagcagcagaagctccagtctgtccttgaggaaatacactgctacgagcctcagctcaacaggctgaaagagaaagctcagcagctgtgggaaggacaagctgccagcaagagctttaggcacagagtgtcgcagctgtcttctcagtatctagcgctaagcaatttaacaaaggagaaagtgtcaagactggatagaatcgttgcagaacacaatcagttctctcttgggattaaagaattacaagactggatgacggatgcgattcacatgctggattcatactgccacccgacatccgacaaaagtgtgctggacagcaggacgctcaagctcgaggtgtgcatctttacacagaaatatctccaacctacagaatttgtttttctcaaaatttcccgtctccatccacctggggtgatgatgtcacattctctccatgataaatctcagatgctttgtgagtgcaacgctgtctgccttgggtgcacatgccagagaattcctgaatcatctgaccccggatgttttccaaaaaataaaataaaataaagcccgaatgtga

SEQ ID NO: 185312 - DNA, 6001 bp, Homo sapiens
  Payload ID: 16494
  Gene Symbol: SYNE1
  Gene Name: spectrin repeat containing, nuclear envelope 1
  ENST ID: ENST00000448038
  CDS Start-End: 3265-4407
ctcgatttgtgccgtcagtctaacaacctgtgcttgcaaagggaagaggatcttcagagaacaagagattaccatgactgtatgaatgttgttgaagtgttcctagaaaaatttactacagaatgggataacttggccagatctgatgcagagagtacagctgtccacctggaagctttgaaaaagttagcattggcattgcaggagagaaagtatgctattgaagatctgaaagatcaaaagcagaaaatgatagagcatctgaatttagatgacaaggagttagtcaaagaacagacgagtcatttagagcaacgttggtttcagcttgaggacctcattaaaaggaaaatccaagtgtcagtcaccaacttggaggagttaaatgtggtgcagtccagatttcaggagctaatggagtgggcagaagagcaacaacccaacatcgccgaggcccttaagcagagccctcctccagatatggctcagaaccttctcatggatcacctggccatctgcagtgaactggaggccaagcagatgctcctgaaatcgcttataaaggacgcagacagggtcatggcagatcttggtctcaatgagcgacaggtcatccagaaggctctctctgatgcacaaagccacgtgaattgtctcagtgacttagtgggccagcgaagaaagtacttaaacaaagccttgtccgagaaaacccagtttctcatggcagtgttccaggccaccagccaaattcagcaacatgagcgaaagataatgttccgtgaacacatctgtctgttaccagatgatgtgagcaaacaagtcaaaacatgtaagagtgcacaagccagcctcaagacttaccaaaatgaagtcactggactttgggcccagggtcgcgaactaatgaaggaagtcacagagcaggaaaagagtgaagtgctggggaagcttcaggaattgcagagtgtctatgacagtgttttacaaaagtgcagtcaccggttacaagaactagagaagaatttggtttctaggaagcattttaaggaagattttgataaagcttgccactggctaaaacaagcagatattgttacatttcctgaaatcaacctaatgaatgagagttctgagcttcatacacaactggctaaataccaaaacattcttgaacaatctccagaatatgaaaatcttctacttacgctgcagagaactgggcagaccatattaccatcgctgaatgaagtcgatcattcctacctcagtgaaaagctaaatgctttgcctcgacaatttaatgtaattgttgccttggctaaagacaagttctataaagtccaggaagcaattcttgctcggaaggaatatgcttccttgattgagttgacaacccagtctctgagtgaacttgaagcccaattcttgaggatgagcaaagttcccaccgacctggccgttgaggaggctctttctctgcaagatggttgcagagccattctggacgaggtggcgggccttggggaggcggtggatgaactgaaccagaaaaaagaaggttttcgcagcacaggtcagccttggcagccagacaagatgctgcaccttgtcaccttatatcacaggctgaagcgacaaacagaacagagggttagcttattagaagacaccaccagtgcttaccaagaacacgagaagatgtgccaacagctggagagacaactgaagtctgtaaaagaggagcagtccaaagtgaatgaggaaacgctgcctgcagaggagaagctcaaaatgtatcactccctggcaggaagtctccaggactcagggattgtactgaaacgagtaaccatacatcttgaagatcttgccccacaccttgaccccttggcttatgagaaagccaggcatcagatccagtcctggcaaggggagttaaaactgttgacttctgccattggtgagacggtgacagaatgtgagagccgaatggtgcagagtatagacttccagactgagatgagtcgctccctggactggctgaggagagtgaaggcagagctcagtgggccggtgtacctagacctcaacctgcaggacatccaagaggaaatcagaaaaatccaaattcatcaggaagaggtccagtccagcttgagaatcatgaatgcgctgagtcacaaggaaaaggagaagttcacaaaggccaaggagctgatttctgcggatttagaacacagcctcgctgagctctcagagctggatggagacatccaggaagccttacgcaccagacaggctaccttgactgaaatatatagccagtgtcaaaggtattatcaggtatttcaagcagccaatgactggcttgaggatgcccaagaattgttacagctggcaggcaatggcctagacgtggagagcgcagaggaaaatctcaaaagccacatggaatttttcagtacagaggatcagttccatagtaacctggaggagctccacagcctggtagccaccctggacccactcatcaagccaaccggcaaagaagacctagaacagaaagtggcttctctggaactcaggagccagaggatgagccgggactctggtgcccaagtggatctcttgcagagatgcacagctcaatggcacgattaccagaaagcaagggaagaggttattgaattgatgaatgatacagaaaagaaattgtctgagttttctttgttgaagacttcgtctagtcatgaagcggaagaaaaattgtcagaacacaaggctttagtgtcagtggttaactctttccatgagaaaattgtggcccttgaggaaaaagcttcacaactggagaaaaccggaaatgatgccagcaaagccaccctgagcaggtcaatgaccaccgtctggcagcgctggacacgccttcgagctgtggcccaggaccaggagaagatcctggaagatgcagtggatgagtggacgggctttaacaacaaggttaaaaaggccactgaaatgattgatcagctgcaagataagttacctggaagttcagcagagaaagcatcgaaagcagagctcttaactcttcttgaataccacgacacgttcgttctggagctggagcagcagcagtcggccttgggcatgctgcggcagcaaaccctgagcatgctccaggatggagccgccccaacccctggggaagagcctccgctcatgcaggaaatcaccgccatgcaagatcggtgcctgaacatgcaggagaaagtgaagactaatggaaagttggtgaagcaagagctgaaggaccgagaaatggtggagactcagatcaattctgtgaaatgttgggttcaggaaacgaaagaatatttagggaatccaacaatagaaatagatgctcaacttgaagaacttcagattctcctaacagaagccacaaatcaccgacagaacattgaaaaaatggcagaagaacagaaggagaagtacttaggtctttataccatattaccttctgaactctcccttcagttggctgaagtggcgttagatctaaagatccgagatcagacattggaagatctactgggaaggatgacttggcaagttcatggtctttttatatttttgagacagagtctcgctctgtcccccaggctggagtgcagtgaaacaatctcagcttactgcaacctcctgggtttaagcagttctcgtgcctcagcctcccaagtagctgggattccaggcatgcaccaccatacccggctaattttttgtatttttagtaaaaagagacaaggttttgccatgttggccagcctggtctcaaactcctggcctcaagtgagctgcctgcctcagcctcccaaagtgctgggattacagatccaagacaaaataaaagaagttgagcagagcaaggccacgagccaggaactcagccggcaaattcagaagttagctaaagacctcacaactattctaactaagctgaaagcgaagacagataatgtagttcaagctaaaactgaccaaaaggtgctgggagaggaattagatggctgtaattcaaagttaatggaattagatgcagcagtacagaaattcttggaacagaatggccaactgggtaagccactggccaagaagataggaaaactgactgaacttcaccagcagaccattagacaagctgagaatcggctctccaagctcaatcaggcagcatcacatttagaagaatacaatgaaatgcttgaattaattttgaagtggattgaaaaagctaaagtcttggctcatggaactattgcatggaattctgcaagccagcttcgggaacaatatattttgcatcaggtaaccttaggaaaaataatctttaaaaagtaaccaagggcaatttgatttaactgggtagactgacacaacacttagagggctgtgatgtaaaatttttggagctaccagataaaaagaatgctaaggtacccctaagttgttcagtagttggacagaaaggagcttctcatgaaatttcatgaaattgaataaataaatatccttgatcttccctaaacctaccttacaccaagacccaaaccaatcagccttgtagaactcattttctgtagcttctttgaaataattatctgcagggatctggtgggaaattctttcctgtgaagagatgcaatgaagtgtggaaagattctagactccacactcagactggtgggaaaaccaagctccgccatgcagggctgtgtgatttggagcagaatgctttgcctctctgaattctgtcttctcatcatttgtatgaagacgtaaataatattcgtatttcagacttatgagatcaagtggtttaaggtacacacgtgcaaacgtctgcctggcacatgcaggtgctcagtgggagatctcccgcctcctccctcagccctcacccaggcctgtcatctggccttccacaggaggtcgggcagcccagagcaagccatgagtccacatcacatgctggctatgttagttcatttcctctgaagttacatgagaaaaatgttccttttctgtcagtcacgtcatccaggaaattatttcatccttttgtaacttaagcttaaattagacacagatagttaataggctagttatcatataataaaatatagggtgacttttataggagttacatgggtatcgagtattctagatttttgtctcttatattatttatgtatccttgtggcctttaaatgaatccctgtttccattcttgtttacagggttctagatcaaagcctcatttttccatttttggaatgctttaacagcttctaatttttccctatattcacagtctttcttctctgatcaatcttgcgtattcttcccacaatgtctttcttaagcaactccaatcttttgctttaagatatgcttagatatgaacagacaggacttaagttaccactgatttgaaaacaatgaaaaaaagccaacatccttagaagtctagaaatgcaaatttcagcaaaaaaagagaggaagaaagacaaacttaactgtcacattcatactgtttctttcaagttcatatttaaggaagtgagagctctcaaacattgctggtatcctggtaaaatctctttgaaaaataattggcaaaatgtatggtgattgtcaaaaatgttgctactctgggccacgtgcggtggctcacacctgtaatcccagcactttgggaggccgaggtgggtggatcacaaggtcaggagttcaagaccagcttggccaatatggtgaaaccccatctctactaaaaatacaaaagttagctgggcatggtggtgggcacctgtagtcccagctactcaggaatctgaggcaggagaatcgcttgaactcgggaggtggaggttgcagtgagccaagatcatgccactgcactccagcctgggtgacagtgagactccatctc

SEQ ID NO: 185313 - DNA, 27436 bp, Homo sapiens
  Payload ID: 16494
  Gene Symbol: SYNE1
  Gene Name: spectrin repeat containing, nuclear envelope 1
  ENST ID: ENST00000423061
  CDS Start-End: 438-26687
cggccgccggccgcagcgggctgagattgttgtcctctgtcaccagggcggctgggctcccgcagtcctgcagaccgcgcccgatcccggcgacagggcgggcggacagccgcgcatccccggggtcccgccgagcctgggcgcagagagccgggaggaagcgttcgctcgcttcgccttgctgctgggaaactgaacgaggccgagagagaaggttcttgagttcatgtaagaggacagtcttaaaacggaagaagaaaaagaagcagttcagtctttgggagagctgcctccttgttgagtgctgcaaaggcctggaattcatttatgacagaatagatctagaaaagtccaagcatgttttctagagtggtgtagccctgtgctgcctccagtgaagagtctcttggtgttggcttcgtgcttccggagggaccatggcaacctccagaggggcctcccggtgtcctcgggatatcgccaatgtgatgcagaggctgcaagatgagcaagagatagtacaaaaacgaactttcacaaaatggatcaactctcatctggccaagcggaaacctccaatggtggtggacgatctttttgaagacatgaaagatggtgttaaactgcttgcccttctggaggtcctgtctgggcagaaactgccttgtgaacaaggacgccggatgaagcgaatccatgctgtggctaacattggcacggcactcaagttcctcgaaggaagaaagtccatgcacagaggatcaccgattaaattagtcaacattaactccaccgatatagctgatggccgaccctcaatagttcttggattgatgtggaccattattctatatttccagattgaagagttgaccagcaacctgccccagctccagtctttgtccagcagcgcatcctccgtggacagcatagttagctctgagactcccagcccaccaagtaaacggaaggtgaccaccaagatccaaggaaatgctaagaaggctttattaaagtgggttcagtacacagctggcaagcagactggaatagaagtaaaagattttgggaagagttggagaagcggggttgcctttcattcagttattcatgccattcgaccggaattggtggacttggagacagtgaaaggcagatccaaccgagaaaatttggaggatgctttcactatcgccgaaacagaactggggatcccaagactgctagatcctgaagacgttgatgtggataaaccagatgagaaatctattatgacctatgtagcccagtttctgaaacattatcctgacatccacaatgcaagcactgatgggcaagaggatgatgaaatacttccaggtttcccatcttttgcaaattctgtacaaaattttaagagagaagacagagtaatttttaaggaaatgaaagtttggatagaacaatttgagagagatttgacaagagcacagatggtggaatcaaatttacaggataaatatcagtcatttaagcacttcagagttcaatatgaaatgaagaggaaacagattgaacatttaatacaaccattacacagagacggtaaattgtcacttgaccaagcattggtaaaacaatcttgggatagagtgacctccaggctctttgactggcatatacagcttgataaatctcttcctgcacctctgggcaccataggtgcctggctgtacagagcggaggtggccctgagagaggaaataaccgttcaacaggtccacgaggaaacagcaaacacgatacaacggaaacttgagcaacataaggatctgcttcaaaacacggatgcccacaaaagagcattccatgaaatctaccggaccaggtctgttaacgggattccagtgccacctgatcaattagaggacatggccgagaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctgaaaaaatgctcaatcaatcagaaaatgccaaaaaggatttttttcgaaatttacctcattggattcagcagcatactgccatgaacgatgctggcaattttctaattgaaacctgtgatgagatggtttcccgtgacctgaagcagcaattactgttgctaaatgggcggtggagggagttgtttatggaagtcaagcaatatgctcaagctgatgagatggacagaatgaagaaggaatacacagactgtgttgttaccctgtctgcttttgcaacggaagcccataagaaactttctgaacccttagaagtctcttttatgaatgtcaagctattaattcaagacttggaggatattgagcagagggtgcctgtgatggatgcccaatacaagataattacaaagacagcacacctcattaccaaagaaagcccccaagaagaaggaaaagaaatgtttgcgaccatgtcaaagctcaaagagcagctaaccaaggtcaaagaatgttactccccactcctttatgagtctcagcagctgttgattccgttggaggaattagaaaagcagatgacgtccttttatgactcacttgggaaaatcaatgaaattatcacagttcttgagcgtgaggcacaatcgagtgccctttttaaacaaaaacatcaggaactgttagcttgtcaagaaaactgtaagaaaaccttgacacttattgagaaaggcagtcaaagtgttcaaaagtttgtgaccttgagcaacgtgttaaagcattttgatcagacgaggctacaaagacagattgcagatattcatgttgcttttcagagtatggtaaagaaaactggagattggaagaagcatgtggaaaccaacagtcgcttgatgaagaagtttgaggagtctcgagcagagttggagaaggtactgcggattgctcaggagggcctggaggaaaagggggatccagaggagctcctgcggagacacactgagtttttcagtcagctggatcagagggtgctcaatgctttcctgaaagcttgtgatgaactcaccgacatccttccagagcaggagcagcaggggctgcaggaagctgttcgaaagctccacaaacaatggaaggatcttcaaggagaagccccttatcatttgcttcatctgaagattgatgtggagaagaataggttcttagcctctgtagaagaatgcagaactgagctggatcgagagaccaagctgatgccccaggaaggcagtgaaaagataattaaagagcacagggttttcttcagtgacaaaggtcctcatcatctctgtgagaaaaggttacagctcatcgaggaactctgtgtgaaactcccagtgcgggacccagtaagggacacacctggaacctgtcacgtgactctcaaagagctcagagctgccattgacagcacctacaggaagctcatggaagacccagacaagtggaaggactacactagcagattctctgagttctcatcttggatatctacaaatgagacacaattaaaggggatcaagggtgaggccatcgatactgccaaccacggagaggttaaacgtgccgttgaagagatcagaaatggtgttaccaaaaggggtgagaccctcagctggctgaaatccaggctgaaagttttgacagaagtttcttctgagaatgaagcccaaaagcagggagatgagctggcaaaattatccagctctttcaaggctcttgtgacgctgctgtcagaggttgaaaagatgctaagcaattttggggactgtgtccagtacaaagaaatagtcaaaaattctctcgaagaattaatttctggctctaaagaagtccaggaacaagctgagaagatcttggatactgaaaatctgtttgaagcacagcagttacttcttcatcaccagcaaaagacaaagcggatctcagcaaagaagagagatgtgcagcagcagatcgcgcaggcgcagcagggagaaggggggctgcctgaccgaggccacgaggagctgcggaagctggagagcacactggatggcctggagcgcagccgggagaggcaggaacgccgcatccaggtcacattaagaaaatgggagcgatttgaaacaaacaaagaaacagtagtaagatacctttttcaaacaggttccagtcatgaacgcttcttgagttttagcagtttggaaagtttatcttcagaactggaacaaacaaaggagttttctaaacggacagaaagtattgcagtccaggctgagaaccttgtaaaggaagcttcagagataccgcttgggccccaaaataagcagctgcttcaacagcaggccaagtcaatcaaagaacaagtcaaaaaattagaagacacgcttgaagaagatattaaaaccatggaaatggtgaaaaccaagtgggatcattttggcagtaattttgagactctgtccgtctggataactgagaaagaaaaagaactcaatgccttggaaacttcgtcatctgccatggacatgcaaatcagccaaattaaggtcacaattcaggaaatagaaagtaagctcagcagcattgtaggattagaagaagaagcccagtcttttgctcagtttgttaccactggagaatctgctcgaattaaagccaagttgacacaaataagaagatacggggaagagcttcgagagcatgcacagtgtctggaaggaacaatcctgggacatttatctcagcagcaaaagtttgaagagaaccttagaaagatccagcaatctgtgtctgaatttgaagataaacttgctgttccaattaaaatatgttcttcagctacagaaacatacaaagttcttcaagaacatatggatctctgccaggccctggagtcactgagcagcgcgatcactgccttctcagccagtgccaggaaggttgtgaacagagattcctgtgttcaggaggctgcggctctacagcagcaatacgaggacatcctaaggagggcgaaggagagacagacggcgctggagaatctgctggcccactggcagaggctagagaaagaactatcatcctttttgacctggttagagcggggtgaagctaaagccagttccccagaaatggacatttctgcagacagagtcaaagtggaaggtgaacttcagttaatacaggcactgcaaaatgaagttgtatcccaggcctcattctatagcaaacttttgcaattgaaggaatcattgttctcagtagcctccaaagatgatgtgaaaatgatgaaactacatttggagcagttggatgagagatggagagatttaccacagatcattaacaaaaggattaattttcttcagtctgtggttgctgaacaccagcaatttgatgagctgctgctttccttttctgtctggattaaactgtttctcagtgaattacaaactacctctgagattagcataatggaccatcaagtagcccttactcggcataaggaccacgcagcagaagtagagagcaaaaagggcgaattgcagagtctgcagggtcacttagcaaagttgggttctctgggccgtgctgaggacctccacctcctgcagggaaaggctgaggactgcttccagctgtttgaggaggccagccaggttgtggagaggcggcagcttgccctgtcccatttggcagaattcctccagagccatgcctctctgtccggcattctccgccagctgaggcaaacagtggaagcaaccaacagtatgaataagaacgagtctgatttgatagaaaaggacctcaatgatgctcttcaaaatgctaaagcattagaatctgctgccgtcagtctggatggcattctttccaaagcccaataccatctgaaaatcgggagctctgagcaaaggacttcctgcagagccacggctgatcagctctgtggagaggtagagaggatccagaaccttctgggaaccaagcagagtgaggcagatgctctggcagtgttgaaaaaagcattccaagaccagaaagaggagcttctgaaaagcattgaggacattgaagaaaggactgacaaagagcgattgaaagaacctacccgccaagctcttcagcagaggttaagagtgtttaatcagctagaagatgaattgaattctcacgagcatgaactatgttggttgaaagacaaagccaagcaaattgcccagaaagatgtagcttttgcacctgaagttgacagggagataaaccgcttagaggtcacctgggatgataccaaaagactaattcatgaaaatcagggtcagtgctgtggacttattgacttaatgagagaatatcagaacctgaaatcagctgtatctaaagtcttagaaaatgccagcagtgtgattgtaaccagaactaccataaaagatcaggaggatcttaaatgggctttttccaagcatgaaactgccaagaacaaaatgaattacaaacagaaagacttggataactttaccagcaaaggaaaacacttgttatctgagctgaagaaaattcacagtagtgatttcagcttggtgaaaacagacatggagagcaccgtggacaaatggctggatgtatcagagaaacttgaagaaaacatggataggctgagagtaagcctgtccatttgggatgatgtactgtcaactagagatgagattgagggatggtcaaacaactgcgttccacagatggcagaaaacatcagcaacctggataaccacctcagagctgaagaactgcttaaagaatttgagtctgaagttaaaaacaaagcattgagattggaagaactgcattccaaagttaatgatctgaaagaattaactaaaaatctagaaacaccgccagaccttcagtttatagaagcagacttaatgcagaaactggagcatgccaaagaaataactgaagtagcaaaaggaaccctgaaggatttcacggctcaaagtacacaagtggagaagtttattaatgacataacaacatggttcacaaaagtggaagaatcgttgatgaactgtgcccaaaatgagacttgtgaagcattgaaaaaagtcaaggatatacaaaaagaacttcaaagtcaacaaagcaacatcagctctacccaagaaaatctcaatagcttgtgccgcaagtaccactcagctgagttggagagcctgggccgtgcaatgactggtctgataaagaaacatgaagccgtgagccagttgtgctccaaaacccaggccagcctgcaggaatctctggaaaaacacttcagtgagtctatgcaggaattccaagaatggtttttgggagcaaaggcagcagcaaaagaatcatcagatcgcaccggtgacagcaaagttctagaagcaaagctccatgatcttcagaacattttggactcagtcagtgatgggcagagcaaacttgatgcagtgactcaagaaggacaaactttgtatgcacatttgtctaaacaaattgtcagtagcattcaagaacaaatcacaaaggccaatgaagagtttcaagcatttctgaaacaatgccttaaagataagcaggctcttcaagactgtgcttcagaacttggaagctttgaagatcagcacagaaaactgaacttatggatccatgaaatggaagaaaggttcaatacggaaaacttgggagagagtaaacagcacattcctgagaagaaaaatgaagttcataaagttgaaatgtttttgggagaactgctggctgcaagagagtctcttgataagctttcccagagagggcagcttctgagtgaagaaggccacggtgctgggcaggagggccgcctgtgttcccagctcctcacaagccaccagaacctacttagaatgaccaaagagaaactccggagctgccaggtggcccttcaggagcacgaagccctggaggaagcactgcaaagcatgtggttctgggtgaaggccattcaggacagactggcctgtgcagagagcactcttgggagcaaagacaccctggagaaacggctgtcacaaatacaggatattctcctgatgaaaggtgaaggggaagttaagttgaatatggccattggcaagggggaacaggccttgagaagtagcaacaaagaaggtcagagggtgattcagactcagttagagacccttaaagaagtgtgggctgacatcatgagctcctccgtccacgctcaaagcactttagagtctgtgattagccaatggaatgactatgtagagaggaaaaaccagttggagcagtggatggaatcagtggatcaaaaaatagaacatcccttacaaccacagccaggtctgaaagagaagttcgtcctgcttgaccacctccagtccatcctgtctgaggcagaagatcacacgagagcccttcaccgtctaattgcgaagtccagggagctctacgaaaagacagaggatgagtctttcaaggacacagctcaagaggagctgaaaacacagtttaatgatataatgactgttgccaaggaaaaaatgaggaaagtggaagagattgtgaaagatcatctaatgtatttagatgcggtccacgagttcacagattggctccattcagcaaaggaagaacttcaccggtggtcagatatgtctggagattcatcagccacccagaaaaagttatcaaaaattaaggagctgatagattccagagagattggtgcaagccgtctcagcagagtggagtcgctggctcccgaagtgaaacagaacacaactgccagtgggtgtgagctcatgcacacggagatgcaggccctgcgtgccgactggaagcagtgggaagacagtgtattccaaacgcagagctgtttggagaacctggtcagccagatggccctttcggagcaggaattctcaggccaagtggctcaactggagcaggccctggaacagttcagtgcccttctgaaaacctgggctcagcagttaaccctcctggaaggcaagaacacggatgaggagatagtggaatgctggcacaaaggacaagagatactggatgctttgcaaaaagcagagcctagaacagaggatctcaagtctcagctgaatgaactttgtcgattttccagagacctgagtacctacagtggaaaagtttctggcttgattaaagagtataattgtctttgtttgcaagcatccaagggctgccagaataaagaacagattttacagcaaagatttcgaaaggccttcagggatttccagcagtggttggttaatgcaaaaatcactaccgccaagtgttttgatatacctcaaaatataagtgaagtttcaactagtcttcagaaaatacaggagtttttgtcagaaagtgaaaatggacagcacaagctaaacatgatgctgtctaaaggggaacttctgagtaccctgctgaccaaagagaaagcgaaagggatccaggccaaagttacagctgcaaaagaagattggaaaaattttcattcaaatctccaccaaaaagaatctgctctagagaatctaaagatccaaatgaaggactttgaagtaagtgctgagcctatccaggactggctgagtaaaactgagaagatggtccatgaaagcagcaatcgcctctatgatctgccagcaaagaggagggagcagcagaagctccagtctgtccttgaggaaatacactgctacgagcctcagctcaacaggctgaaagagaaagctcagcagctgtgggaaggacaagctgccagcaagagctttaggcacagagtgtcgcagctgtcttctcagtatctagcgctaagcaatttaacaaaggagaaagtgtcaagactggatagaatcgttgcagaacacaatcagttctctcttgggattaaagaattacaagactggatgacggatgcgattcacatgctggattcatactgccacccgacatccgacaaaagtgtgctggacagcaggacgctcaagctcgaggctctattatcagtcaaacaggaaaaagagattcagatgaaaatgatagtgaccaggggagaatctgtccttcagaatacttctccagaaggcattcccactattcagcagcagctgcagagtgtgaaggatatgtgggcatcccttttgtctgcagggattcgttgtaaaagccaactcgaaggagctctctccaagtggacaagttatcaggatggcgttcgacagttctccggttggatggatagtatggaagccaacctgaatgaatcagaaaggcagcatgcggagctgcgggataaaacaacgatgctcggaaaagccaagttattaaatgaagaagtgctgagttacagcagcttgctggagaccatcgaagtcaaaggggctggcatgacagaacactatgtcacccagctagaactccaggatctacaggaacgatacagagccatccaagagagggccaaggaagccgtaaccaagtctgaaaaacttgtccgcctgcaccaagagtatcagagagacctaaaggcatttgaagtttggttggggcaagaacaagaaaagctcgaccagtattcagttcttgaaggtgatgcccacactcatgagacaacattgcgtgatcttcaggagctacaggtacactgtgcagaggggcaggccctgttgaactcagtgctgcacaccagagaggatgtgatcccatcaggtatcccacaggcagaggaccgggctttagagtctctccggcaagactggcaggcttaccagcacaggctgtccgagactcgaactcagttcaataacgtggtgaacaaattgaggctaatggagcaaaagtttcagcaagtagatgaatggctcaaaacagcagaggagaaaaagtggcacgaagaagtgactgcatacagagatgaagttgaggaagtgggagctagagctcaggagatactggacgagagccacgtgaacagcagaatgggttgccaggccacccagctgacttccagataccaggccctgcttctccaagtgctggaacaaataaaattcctggaggaggagattcagagtttggaggaatcagaatcatccctcagttcctattctgattggtatggctctactcataaaaacttcaagaatgtggctaccaagattgacaaagtagatacagtaatgatggggaagaaattgaagacgttggaggttttgctcaaagacatggagaaaggtcacagtttgctgaaatcagcccgggagaaaggagagagggctgttaaatacttggaggaaggcgaggcagagaggttaagaaaggagattcatgatcacatggagcagttgaaggaactgaccagcactgtccggaaagaacacatgacgctggaaaaaggtcttcatttagcaaaggaattctcagataaatgcaaagcactgacacagtggatagcagaataccaggaaattctacatgttcctgaagaacccaaaatggaattatatgagaaaaaagctcagttatctaaatacaagtcacttcaacaaacggtgctgtcccatgaaccatcagtaaagtcagtgagagagaagggtgaagctcttttggaactggtgcaggacgtcactttaaaggacaaaatagatcaacttcaaagtgattaccaggacctgtgcagcataggaaaggcaatgatggaagaaattgctggttttgaagaccgtttgaacaatcttcaaatgaaaggtgatactttgattggccaatgtgcagaccacctgcaagcgaaacttaaacaaaacgtgcatgctcatctgcagggcacaaaggacagctactcagcgatctgcagcacagctcagaggatgtaccagagtttggaacacgaacttcagaagcacgtcagccgacaagacaccctgcagcagtgccaggcctggctttctgcagtccagccggatttagagccaagtcctcaaccacctcttagtagggcagaagccattaagcaggtcaaacacttcagagctttgcaagagcaggcaaggacctacctagatctcctttgctccatgtgtgacctgtcaaatgcttcggtgaaaaccacagcaaaagacattcaacaaacagagcaaacgattgaacaaaagcttgtccaggcccagaacttaactcagggctgggaagagatcaagcacctgaagtctgagctctggatttacctgcaagatgctgatcagcaactgcagaacatgaagaggaggcactctgagctggagctgaacattgcacagaacatggtttcacaagttaaggattttgttaagaaactacagagcaaacaggcatccgtgaacaccataatagaaaaggtgaataagttaacaaagaaggaggaatcgcctgaacacaaggaaataaatcatttaaatgatcagtggctcgatttgtgccgtcagtctaacaacctgtgcttgcaaagggaagaggatcttcagagaacaagagattaccatgactgtatgaatgttgttgaagtgttcctagaaaaatttactacagaatgggataacttggccagatctgatgcagagagtacagctgtccacctggaagctttgaaaaagttagcattggcattgcaggagagaaagtatgctattgaagatctgaaagatcaaaagcagaaaatgatagagcatctgaatttagatgacaaggagttagtcaaagaacagacgagtcatttagagcaacgttggtttcagcttgaggacctcattaaaaggaaaatccaagtgtcagtcaccaacttggaggagttaaatgtggtgcagtccagatttcaggagctaatggagtgggcagaagagcaacaacccaacatcgccgaggcccttaagcagagccctcctccagatatggctcagaaccttctcatggatcacctggccatctgcagtgaactggaggccaagcagatgctcctgaaatcgcttataaaggacgcagacagggtcatggcagatcttggtctcaatgagcgacaggtcatccagaaggctctctctgatgcacaaagccacgtgaattgtctcagtgacttagtgggccagcgaagaaagtacttaaacaaagccttgtccgagaaaacccagtttctcatggcagtgttccaggccaccagccaaattcagcaacatgagcgaaagataatgttccgtgaacacatctgtctgttaccagatgatgtgagcaaacaagtcaaaacatgtaagagtgcacaagccagcctcaagacttaccaaaatgaagtcactggactttgggcccagggtcgcgaactaatgaaggaagtcacagagcaggaaaagagtgaagtgctggggaagcttcaggaattgcagagtgtctatgacagtgttttacaaaagtgcagtcaccggttacaagaactagagaagaatttggtttctaggaagcattttaaggaagattttgataaagcttgccactggctaaaacaagcagatattgttacatttcctgaaatcaacctaatgaatgagagttctgagcttcatacacaactggctaaataccaaaacattcttgaacaatctccagaatatgaaaatcttctacttacgctgcagagaactgggcagaccatattaccatcgctgaatgaagtcgatcattcctacctcagtgaaaagctaaatgctttgcctcgacaatttaatgtaattgttgccttggctaaagacaagttctataaagtccaggaagcaattcttgctcggaaggaatatgcttccttgattgagttgacaacccagtctctgagtgaacttgaagcccaattcttgaggatgagcaaagttcccaccgacctggccgttgaggaggctctttctctgcaagatggttgcagagccattctggacgaggtggcgggccttggggaggcggtggatgaactgaaccagaaaaaagaaggttttcgcagcacaggtcagccttggcagccagacaagatgctgcaccttgtcaccttatatcacaggctgaagcgacaaacagaacagagggttagcttattagaagacaccaccagtgcttaccaagaacacgagaagatgtgccaacagctggagagacaactgaagtctgtaaaagaggagcagtccaaagtgaatgaggaaacgctgcctgcagaggagaagctcaaaatgtatcactccctggcaggaagtctccaggactcagggattgtactgaaacgagtaaccatacatcttgaagatcttgccccacaccttgaccccttggcttatgagaaagccaggcatcagatccagtcctggcaaggggagttaaaactgttgacttctgccattggtgagacggtgacagaatgtgagagccgaatggtgcagagtatagacttccagactgagatgagtcgctccctggactggctgaggagagtgaaggcagagctcagtgggccggtgtacctagacctcaacctgcaggacatccaagaggaaatcagaaaaatccaaattcatcaggaagaggtccagtccagcttgagaatcatgaatgcgctgagtcacaaggaaaaggagaagttcacaaaggccaaggagctgatttctgcggatttagaacacagcctcgctgagctctcagagctggatggagacatccaggaagccttacgcaccagacaggctaccttgactgaaatatatagccagtgtcaaaggtattatcaggtatttcaagcagccaatgactggcttgaggatgcccaagaattgttacagctggcaggcaatggcctagacgtggagagcgcagaggaaaatctcaaaagccacatggaatttttcagtacagaggatcagttccatagtaacctggaggagctccacagcctggtagccaccctggacccactcatcaagccaaccggcaaagaagacctagaacagaaagtggcttctctggaactcaggagccagaggatgagccgggactctggtgcccaagtggatctcttgcagagatgcacagctcaatggcacgattaccagaaagcaagggaagaggttattgaattgatgaatgatacagaaaagaaattgtctgagttttctttgttgaagacttcgtctagtcatgaagcggaagaaaaattgtcagaacacaaggctttagtgtcagtggttaactctttccatgagaaaattgtggcccttgaggaaaaagcttcacaactggagaaaaccggaaatgatgccagcaaagccaccctgagcaggtcaatgaccaccgtctggcagcgctggacacgccttcgagctgtggcccaggaccaggagaagatcctggaagatgcagtggatgagtggacgggctttaacaacaaggttaaaaaggccactgaaatgattgatcagctgcaagataagttacctggaagttcagcagagaaagcatcgaaagcagagctcttaactcttcttgaataccacgacacgttcgttctggagctggagcagcagcagtcggccttgggcatgctgcggcagcaaaccctgagcatgctccaggatggagccgccccaacccctggggaagagcctccgctcatgcaggaaatcaccgccatgcaagatcggtgcctgaacatgcaggagaaagtgaagactaatggaaagttggtgaagcaagagctgaaggaccgagaaatggtggagactcagatcaattctgtgaaatgttgggttcaggaaacgaaagaatatttagggaatccaacaatagaaatagatgctcaacttgaagaacttcagattctcctaacagaagccacaaatcaccgacagaacattgaaaaaatggcagaagaacagaaggagaagtacttaggtctttataccatattaccttctgaactctcccttcagttggctgaagtggcgttagatctaaagatccgagatcagatccaagacaaaataaaagaagttgagcagagcaaggccacgagccaggaactcagccggcaaattcagaagttagctaaagacctcacaactattctaactaagctgaaagcgaagacagataatgtagttcaagctaaaactgaccaaaaggtgctgggagaggaattagatggctgtaattcaaagttaatggaattagatgcagcagtacagaaattcttggaacagaatggccaactgggtaagccactggccaagaagataggaaaactgactgaacttcaccagcagaccattagacaagctgagaatcggctctccaagctcaatcaggcagcatcacatttagaagaatacaatgaaatgcttgaattaattttgaagtggattgaaaaagctaaagtcttggctcatggaactattgcatggaattctgcaagccagcttcgggaacaatatattttgcatcagaccctgctagaagaatccaaagaaattgacagtgagctggaagcaatgactgagaaattacagtacctcactagcgtgtactgtacagaaaaaatgtctcagcaagtggcagaactgggacgggagactgaggagttgcgacagatgatcaaaattcgtttgcagaacctccaagatgcagctaaggatatgaaaaaatttgaagcagagttgaaaaagttacaagctgccttggagcaagcccaggcaacactgacttctccagaagttggacgtctcagtctcaaggagcagctctctcatcggcagcatttgttgtctgagatggagtcactgaagccgaaggtgcaagcagtgcagctctgccagagtgccctccggatccccgaggatgtggttgccagcttacctctctgtcatgctgctctgcggctgcaggaagaggccagccggctgcagcacaccgccatccagcagtgtaacatcatgcaggcagctgtggtacaatatgaacaatatgagcaagaaatgaaacatctccagcaactgatagaaggagctcacagagagattgaggataaacctgttgccaccagtaacatacaggagctgcaggctcagatttctcggcatgaggagctggcgcagaaaattaagggctaccaggagcagatcgcttctttgaattccaagtgcaagatgctgacgatgaaagccaagcacgccaccatgctgctgacggtgaccgaggtcgaggggctggcggaagggacagaggacctggatggggagctcctccccacgccttcggcccacccctctgtggtcatgatgactgcaggtcgctgtcacactttgctgtcaccggtcactgaggagtctggggaggagggaaccaacagtgagatttcctctccacctgcctgtcgctccccttcacctgtggctaatacagatgcttctgttaaccaggacattgcatattaccaagccttgtctgctgagaggttgcagacagatgctgcaaaaattcaccccagcacatccgcatcccaggagttctatgaaccgggattggagccatccgctactgccaaactgggtgatttgcagcgttcttgggaaaccttaaagaatgtgatcagtgagaagcagcgcacactctatgaagctttggaacgccagcagaagtaccaggactccctccagtccatctctacgaagatggaggccattgagctgaaactcagtgagagcccagagcctggcaggagtccagaaagccagatggctgaacatcaggcattgatggatgagattctcatgctccaggatgaaatcaatgagctccagtcctctctcgcagaggagctggtatccgagtcttgtgaggccgaccctgcggagcagctggccttgcagtccacgctcactgtcttagccgagcgaatgtccaccatcaggatgaaagcctcggggaaacggcagcttttggaggagaagttgaatgatcagctggaggaacaaaggcaggaacaggccctgcagaggtatcgctgtgaagccgatgagctggacagctggctcttgagtaccaaggccactctggacactgcgctgagtccacccaaggagcccatggacatggaggcccagcttatggactgccagaatatgctggtggaaatagagcagaaggtggtggctttatcagaactgtcagtccacaatgagaacctgctgctggagggcaaagctcacaccaaggacgaggccgagcagctggctggaaagctgagaaggctcaaggggagcctgctggagctgcagagagccctgcatgataagcagctcaacatgcagggaacagcacaggagaaggaggagagcgatgttgacctaacagccacgcagagccccggcgtccaggaatggctggcccaagctcgcaccacatggacccagcagcggcagagcagtctccagcaacaaaaagagttagaacaggaattagccgagcagaagagtctccttcgctcagtagccagtcgtggagaggagattctaattcaacattcggcggcagagacctctggtgatgctggcgaaaaacctgatgtgttatcccaggagttggggatggaaggggagaaatcatccgctgaagaccagatgagaatgaaatgggaaagcctacatcaagaatttagtaccaagcagaaactactacagaatgttctggaacaggaacaagagcaagtgctttatagcaggccaaatcgactcttgtctggtgtgccactgtacaaaggggacgtgccaacccaagataaatctgcagttacatctttgctggatggactgaaccaagccttcgaggaggtttcatcccagagtggaggggcaaagaggcagagtatacacttggagcagaagttgtatgatggagtctcagccacctctacttggttggatgacgttgaagaacgtttatttgttgccacagcacttttaccagaagaaacagagacttgtctcttcaaccaagagattcttgccaaagacattaaggaaatgtctgaagaaatggataagaacaaaaacttgttttcccaagcttttccagagaatggtgataatcgagatgttattgaagatactttgggttgtcttttgggcaggttatccttgctagactcagtagtgaatcaacgatgtcatcagatgaaagaaagacttcagcaaatactaaatttccagaatgatctgaaagtgctgtttacatcactggctgacaacaaatacatcattctgcaaaaactggcaaatgtgtttgaacagcccgtagcagaacaaatagaggcaatacaacaggctgaagatggactcaaagaatttgatgcaggaatcattgaattaaagaggcgtggtgacaagctacaggtcgagcagccgtccatgcaagaactctccaagctccaggacatgtatgatgagctgatgatgatcattggctcccggaggagtggtctgaatcagaaccttacactcaagagtcagtatgagagggccctacaagatctggctgacctgctagaaactggtcaggagaagatggcaggagaccagaaaatcatcgtgtcttccaaagaggaaatccagcaactacttgacaaacataaggaatactttcagggcctggaatctcatatgatcttgactgaaacactcttcagaaagataatcagctttgcagtccaaaaggaaacccagttccatacagagctgatggctcaggcttctgctgtactgaaacgggctcacaagaggggtgtggagctggagtacattctagagacgtggtcccatctggatgaggaccagcaggagctcagcagacagctggaggtggtggaaagcagcatcccaagcgtgggtctggtggaggagaacgaggacaggcttattgaccgcataacactctaccagcatttaaaatctagccttaatgaataccagcccaaattatatcaagtattagatgatgggaaacgacttctgatatccatcagctgctcagatctagaaagccaactaaatcaacttggagagtgctggctaagtaacaccaataaaatgtctaaggaacttcacagactggaaacaatattgaaacactggaccagatatcaaagtgaatctgcagatctaattcactggttacaatctgcaaaagaccggctagaattttggactcagcaatctgtgacagtcccacaagagctggaaatggtccgtgatcatctaaatgctttcctggagttttctaaagaagtggatgcccaatcttccctgaaatcatctgttctgagtactggaaatcagctccttcgactaaaaaaggtggacacagccacgctgcgctctgagctgtcgcgcattgatagccagtggactgacctgctaaccaatatcccagccgtccaggagaagctccaccagctccagatggataaactgccttcccgccatgccatttctgaagtcatgagttggatttctctaatggaaaatgttattcagaaggatgaagataatattaaaaattccataggttacaaggcaattcatgaataccttcagaaatataagggttttaagatagacattaactgtaaacagctgacagtggattttgtgaaccagtccgtgctacaaatcagcagtcaggatgtggaaagtaagcgtagtgataagactgattttgctgagcaacttggagcaatgaataaaagttggcaaattctgcaaggtctagtaactgagaagatccagctgttggaaggcttattggaatcttggtcagaatatgaaaataatgtacaatgtctgaaaacatggtttgaaacccaggaaaagagactaaaacaacagcatcgaattggagatcaggcttctgttcaaaatgcactgaaagactgtcaggatctggaagatttgattaaagcaaaagaaaaagaagtagagaaaattgagcagaatggacttgctttgattcagaacaagaaagaagacgtctctagcattgtcatgagcacactgcgagagctcggccaaacctgggcaaatttagatcacatggttggacaattaaagatactgctgaaatcagtgcttgaccaatggagtagtcacaaagtggcctttgacaagataaacagttacctcatggaggccagatactctctttcccgattccgtctgctgactggctccttagaagctgtgcaagttcaggtggacaatcttcagaatctccaagatgatctggaaaaacaggaaaggagcttacagaaatttggctctatcaccaaccaattattaaaagagtgtcacccacccgtgacagaaactcttaccaatacactgaaagaagtcaacatgagatggaataacttgctggaagagattgctgagcagctacagtccagcaaggccctacttcagctttggcaaagatacaaggactactccaaacagtgtgcttcgacagttcagcagcaggaggatcgaaccaatgagctgttgaaggcagccacaaacaaggacattgccgatgatgaggttgccacatggattcaagattgcaacgacctcctcaaaggactgggcacagttaaagattccctcttttttctccatgagctgggagagcaactgaagcaacaagtggatgcttccgcagcatcagctattcaatcggatcaactctctttgagtcaacacttgtgtgccctggagcaagctctctgcaaacagcagacttcattacaggctggagttcttgattatgaaacctttgccaagagtttagaagctttggaggcctggatagtggaagctgaagaaatactacaagggcaggaccctagccactcatctgacctctccacaatccaggaaaggatggaagaacttaagggacagatgttaaaattcagcagcatggctccagatttagaccgtctaaatgagcttggatataggttacccttgaatgataaggaaatcaaaagaatgcagaatctgaaccgccattggtctctgatctcctctcagactacagaaagattcagcaagttgcagtcatttttgctacaacatcagactttcttggaaaaatgtgaaacatggatggaattcctagttcagacagaacaaaagttagcagtagagatttcaggaaattatcagcaccttttggaacagcagagagcacacgagttgtttcaagccgagatgttcagtcgtcagcagattttgcactcaatcattattgatgggcaacgtcttctagaacaaggtcaagttgatgacagggatgaattcaacctgaaattgacactcctcagtaatcaatggcagggagtgattcgcagggcccagcagaggcgggggatcattgacagccagattcgccagtggcagcgctatagggagatggcagaaaagcttcgtaaatggttggttgaagtgtcctacctccccatgagtggtctcggaagtgttcctataccactgcaacaagcaaggaccctctttgatgaagtgcagttcaaagaaaaagtgtttctgcggcaacaaggcagctacatcctgactgtggaggctggcaagcaactccttctctcggcggacagtggcgctgaggccgccttgcaggccgaactcgctgaaatccaagagaaatggaaatcagccagcatgcggctggaagaacagaagaaaaaactagccttcttgttgaaagactgggaaaaatgtgagaaaggaatagcagattccctggagaaactacgaactttcaaaaagaagctttcgcagtctctcccggatcaccatgaagagctccatgcagaacaaatgcgttgcaaggaattagaaaatgcagttgggagctggacagatgacttgacccagttgagcctgctgaaggacaccctctctgcctatatcagtgctgatgatatctccattcttaatgaacgcgtagagcttctgcaaaggcagtgggaagaactatgccaccagctctccttaaggcggcagcaaataggtgaaagattgaatgaatgggcagtcttcagtgaaaagaacaaggaactctgtgagtggttgactcaaatggaaagcaaagtttctcagaatggagacattctcattgaagaaatgatagagaagctcaagaaggattatcaagaggaaattgctattgctcaagagaacaaaatacagctccaacaaatgggagaacgacttgctaaagccagccatgaaagcaaagcatctgagattgaatacaagctgggaaaggtcaacgaccggtggcagcatctcctggacctcattgcagccagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttggcttatcagatgtaatgatccccgaaagccctgaggcctatgtaaaactcacagaaaatgcaatcaaaaatacctccggggaccacagtgccctagagtcacagatccgacaactgggcaaagccctggatgatagccgttttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaaagatatttatgtatgtacagtttgctaaagccaagttttgtttgtattgatttctttgcatttattatagatattataaaata

SEQ ID NO: 185314 - DNA, 4860 bp, Homo sapiens
  Payload ID: 16494
  Gene Symbol: SYNE1
  Gene Name: spectrin repeat containing, nuclear envelope 1
  Uniprot ID: Q8NF91
  ENST ID: ENST00000413186
  CDS Start-End: 1-4332
atggcaacctccagaggggcctcccggtgtcctcgggatatcgccaatgtgatgcagaggctgcaagatgagcaagagatagtacaaaaacgaactttcacaaaatggatcaactctcatctggccaagcggaaacctccaatggtggtggacgatctttttgaagacatgaaagatggtgttaaactgcttgcccttctggaggtcctgtctgggcagaaactgccttgtgaacaaggacgccggatgaagcgaatccatgctgtggctaacattggcacggcactcaagttcctcgaaggaagaaagattaaattagtcaacattaactccaccgatatagctgatggccgaccctcaatagttcttggattgatgtggaccattattctatatttccagattgaagagttgaccagcaacctgccccagctccagtctttgtccagcagcgcatcctccgtggacagcatagttagctctgagactcccagcccaccaagtaaacggaaggtgaccaccaagatccaaggaaatgctaagaaggctttattaaagtgggttcagtacacagctggcaagcagactggaatagaagtaaaagattttgggaagagttggagaagcggggttgcctttcattcagttattcatgccattcgaccggaattggtggacttggagacagtgaaaggcagatccaaccgagaaaatttggaggatgctttcactatcgccgaaacagaactggggatcccaagactgctagatcctgaagacgttgatgtggataaaccagatgagaaatctattatgacctatgtagcccagtttctgaaacattatcctgacatccacaatgcaagcactgatgggcaagaggatgatgaaatacttccaggtttcccatcttttgcaaattctgtacaaaattttaagagagaagacagagtaatttttaaggaaatgaaagtttggatagaacaatttgagagagatttgacaagagcacagatggtggaatcaaatttacaggataaatatcagtcatttaagcacttcagagttcaatatgaaatgaagaggaaacagattgaacatttaatacaaccattacacagagacggtaaattgtcacttgaccaagcattggtaaaacaatcttgggatagagtgacctccaggctctttgactggcatatacagcttgataaatctcttcctgcacctctgggcaccataggtgcctggctgtacagagcggaggtggccctgagagaggaaataaccgttcaacaggtccacgaggaaacagcaaacacgatacaacggaaacttgagcaacataaggatctgcttcaaaacacggatgcccacaaaagagcattccatgaaatctaccggaccaggtctgttaacgggattccagtgccacctgatcaattagaggacatggccgagaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctgaaaaaatgctcaatcaatcagaaaatgccaaaaaggatttttttcgaaatttacctcattggattcagcagcatactgccatgaacgatgctggcaattttctaattgaaacctgtgatgagatggtttcccgtgacctgaagcagcaattactgttgctaaatgggcggtggagggagttgtttatggaagtcaagcaatatgctcaagctgatgagatggacagaatgaagaaggaatacacagactgtgttgttaccctgtctgcttttgcaacggaagcccataagaaactttctgaacccttagaagtctcttttatgaatgtcaagctattaattcaagacttggaggatattgagcagagggtgcctgtgatggatgcccaatacaagataattacaaagacagcacacctcattaccaaagaaagcccccaagaagaaggaaaagaaatgtttgcgaccatgtcaaagctcaaagagcagctaaccaaggtcaaagaatgttactccccactcctttatgagtctcagcagctgttgattccgttggaggaattagaaaagcagatgacgtccttttatgactcacttgggaaaatcaatgaaattatcacagttcttgagcgtgaggcacaatcgagtgccctttttaaacaaaaacatcaggaactgttagcttgtcaagaaaactgtaagaaaaccttgacacttattgagaaaggcagtcaaagtgttcaaaagtttgtgaccttgagcaacgtgttaaagcattttgatcagacgaggctacaaagacagattgcagatattcatgttgcttttcagagtatggtaaagaaaactggagattggaagaagcatgtggaaaccaacagtcgcttgatgaagaagtttgaggagtctcgagcagagttggagaaggtactgcggattgctcaggagggcctggaggaaaagggggatccagaggagctcctgcggagacacactgagtttttcagtcagctggatcagagggtgctcaatgctttcctgaaagcttgtgatgaactcaccgacatccttccagagcaggagcagcaggggctgcaggaagctgttcgaaagctccacaaacaatggaaggatcttcaaggagaagccccttatcatttgcttcatctgaagattgatgtggagaagaataggttcttagcctctgtagaagaatgcagaactgagctggatcgagagaccaagctgatgccccaggaaggcagtgaaaagataattaaagagcacagggttttcttcagtgacaaaggtcctcatcatctctgtgagaaaaggttacagctcatcgaggaactctgtgtgaaactcccagtgcgggacccagtaagggacacacctggaacctgtcacgtgactctcaaagagctcagagctgccattgacagcacctacaggaagctcatggaagacccagacaagtggaaggactacactagcagattctctgagttctcatcttggatatctacaaatgagacacaattaaaggggatcaagggtgaggccatcgatactgccaaccacggagaggttaaacgtgccgttgaagagatcagaaatggtgttaccaaaaggggtgagaccctcagctggctgaaatccaggctgaaagttttgacagaagtttcttctgagaatgaagcccaaaagcagggagatgagctggcaaaattatccagctctttcaaggctcttgtgacgctgctgtcagaggttgaaaagatgctaagcaattttggggactgtgtccagtacaaagaaatagtcaaaaattctctcgaagaattaatttctggctctaaagaagtccaggaacaagctgagaagatcttggatactgaaaatctgtttgaagcacagcagttacttcttcatcaccagcaaaagacaaagcggatctcagcaaagaagagagatgtgcagcagcagatcgcgcaggcgcagcagggagaaggggggctgcctgaccgaggccacgaggagctgcggaagctggagagcacactggatggcctggagcgcagccgggagaggcaggaacgccgcatccaggtcacattaagaaaatgggagcgatttgaaacaaacaaagaaacagtagtaagatacctttttcaaacaggttccagtcatgaacgcttcttgagttttagcagtttggaaagtttatcttcagaactggaacaaacaaaggagttttctaaacggacagaaagtattgcagtccaggctgagaaccttgtaaaggaagcttcagagataccgcttgggccccaaaataagcagctgcttcaacagcaggccaagtcaatcaaagaacaagtcaaaaaattagaagacacgcttgaagaagagtatgtgattgacaagtcctaaactttcttctctgagataaagtttcatacaatctttcctgtaccttgtattcaaaacactcttttaaaatctcaaagtgtctgtgtatttcagcatgttttgaggaaacaactcacagttcaaaagaaagtatcgctaatacagaaaccaatatctataacagagcccaaaaaatataaaggatgtgggttttgcatcttaaactgatcatgttcatgagaaagccatatctattctattctgtggcctttgtacattgtagagggaatcttgaaaaagaactaatatttaaaataatttttttactatattattctgctgtcaccatttagagcgaaaaggagatattttgttagtgtagattccaggcctaaatacacatcacatagaccatatatctccaacctgaagaagctcctggagcttgtttacagtgcctcggtattcaagttatcctgactaatatgctctttccagaaattaactttaaaatattttatttttaaacttttaatgtttgtttatctg

SEQ ID NO: 185315 - DNA, 776 bp, Homo sapiens
  Payload ID: 16494
  Gene Symbol: SYNE1
  Gene Name: spectrin repeat containing, nuclear envelope 1
  ENST ID: ENST00000540663
  CDS Start-End: 49-776
actacttctgtttccttttgatgctgctctgacaccccggtgggggaaatgtttcctcaggagctggcgcagaaaattaagggctaccaggagcagatcgcttctttgaattccaagtgcaagatgctgacgatgaaagccaagcacgccaccatgctgctgacggtgaccgaggtcgaggggctggcggaagggacagaggacctggatggggagctcctccccacgccttcggcccacccctctgtggtcatggacattgcatattaccaagccttgtctgctgagaggttgcagacagatgctgcaaaaattcaccccagcacatccgcatcccaggagttctatgaaccgggattggagccatccgctactgccaaactgggtgatttgcagcgttcttgggaaaccttaaagaatgtgatcagtgagaagcagcgcacactctatgaagctttggaacgccagcagaagtaccaggactccctccagtccatctctacgaagatggaggccattgagctgaaactcagtgagagcccagagcctggcaggagtccagaaagccagatggctgaacatcaggcattgatggatgagattctcatgctccaggatgaaatcaatgagctccagtcctctctcgcagaggagctggtatccgagtcttgtgaggccgaccctgcggagcagctggccttgcagtccacgctcactgtcttagccgagcgaatgtccaccatcaggatgaaagcctcggggaaacggcagctttt

SEQ ID NO: 185316 - DNA, 1907 bp, Homo sapiens
  Payload ID: 16494
  Gene Symbol: SYNE1
  Gene Name: spectrin repeat containing, nuclear envelope 1
  ENST ID: ENST00000495090
  CDS Start-End: 10-1848
aattattagatgcagttccagcatagtgttttaagtacaagcacccagctcctattcaaggatctgcttcaaaacacggatgcccacaaaagagcattccatgaaatctaccggaccaggtctgttaacgggattccagtgccacctgatcaattagaggacatggccgagaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctgaaaaaatgctcaatcaatcagaaaatgccaaaaaggatttttttcgaaatttacctcattggattcagcagcatactgccatgaacgatgctggcaattttctaattgaaacctgtgatgagatggtttcccgtgacctgaagcagcaattactgttgctaaatgggcggtggagggagttgtttatggaagtcaagcaatatgctcaagctgatgagatggacagaatgaagaaggaatacacagactgtgttgttaccctgtctgcttttgcaacggaagcccataagaaactttctgaacccttagaagtctcttttatgaatgtcaagctattaattcaagacttggaggatattgagcagagggtgcctgtgatggatgcccaatacaagataattacaaagacagcacacctcattaccaaagaaagcccccaagaagaaggaaaagaaatgtttgcgaccatgtcaaagctcaaagagcagctaaccaaggtcaaagaatgttactccccactcctttatgagtctcagcagctgttgattccgttggaggaattagaaaagcagatgacgtccttttatgactcacttgggaaaatcaatgaaattatcacagttcttgagcgtgaggcacaatcgagtgccctttttaaacaaaaacatcaggaactgttagcttgtcaagaaaactgtaagaaaaccttgacacttattgagaaaggcagtcaaagtgttcaaaagtttgtgaccttgagcaacgtgttaaagcattttgatcagacgaggctacaaagacagattgcagatattcatgttgcttttcagagtatggtaaagaaaactggagattggaagaagcatgtggaaaccaacagtcgcttgatgaagaagtttgaggagtctcgagcagagttggagaaggtactgcggattgctcaggagggcctggaggaaaagggggatccagaggagctcctgcggagacacactgagtttttcagtcagctggatcagagggtgctcaatgctttcctgaaagcttgtgatgaactcaccgacatccttccagagcaggagcagcaggggctgcaggaagctgttcgaaagctccacaaacaatggaaggtgagtcaggacaggacggagacaccgtgcatcctcaatgaagggagaagcttgagcgtgttaaggtccaaatgtaagagaaatttagaaattcctggaaagtcactgtaactatttcgctcatttaaaaactcaaaaaactggacttaaataaaacctgataatatatg

SEQ ID NO: 185317 - DNA, 1798 bp, Homo sapiens
  Payload ID: 16494
  Gene Symbol: SYNE1
  Gene Name: spectrin repeat containing, nuclear envelope 1
  ENST ID: ENST00000474655
  CDS Start-End: 1-188
agttccagcatagtgttttaagtacaagcacccagctcctattcaaggatctgcttcaaaacacggatgcccacaaaagagcattccatgaaatctaccggaccaggtctgttaacgggattccagtgccacctgatcaattagaggacatggccgagagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctgaaaaaatgctcaatcaatcagaaaatgccaaaaaggatttttttcgaaatttacctcattggattcagcagcatactgccatgaacgatgctggcaattttctaattgaaacctgtgatgagatggtttcccgtgacctgaagcagcaattactgttgctaaatgggcggtggagggagttgtttatggaagtcaagcaatatgctcaagctgatgagatggacagaatgaagaaggaatacacagactgtgttgttaccctgtctgcttttgcaacggaagcccataagaaactttctgaacccttagaagtctcttttatgaatgtcaagctattaattcaagacttggaggatattgagcagagggtgcctgtgatggatgcccaatacaagataattacaaagacagcacacctcattaccaaagaaagcccccaagaagaaggaaaagaaatgtttgcgaccatgtcaaagctcaaagagcagctaaccaaggtcaaagaatgttactccccactcctttatgagtctcagcagctgttgattccgttggaggaattagaaaagcagatgacgtccttttatgactcacttgggaaaatcaatgaaattatcacagttcttgagcgtgaggcacaatcgagtgccctttttaaacaaaaacatcaggaactgttagcttgtcaagaaaactgtaagaaaaccttgacacttattgagaaaggcagtcaaagtgttcaaaagtttgtgaccttgagcaacgtgttaaagcattttgatcagacgaggctacaaagacagattgcagatattcatgttgcttttcagagtatggtaaagaaaactggagattggaagaagcatgtggaaaccaacagtcgcttgatgaagaagtttgaggagtctcgagcagagttggagaaggtactgcggattgctcaggagggcctggaggaaaagggggatccagaggagctcctgcggagacacactgagtttttcagtcagctggatcagagggtgctcaatgctttcctgaaagcttgtgatgaactcaccgacatccttccagagcaggagcagcaggggctgcaggaagctgttcgaaagctccacaaacaatggaaggtgagtcaggacaggacggagacaccgtgcatcctcaatgaagggagaagcttgagcgtgttaaggtccaaatgtaagagaaatttagaaattcctggaaagtcactgtaactatttcgctcatttaaaaactcaaaaaactggacttaaataaaacctgataatatat

SEQ ID NO: 185318 - DNA, 3768 bp, Homo sapiens
  Payload ID: 16494
  Gene Symbol: SYNE1
  Gene Name: spectrin repeat containing, nuclear envelope 1
  ENST ID: ENST00000539504
  CDS Start-End: 161-3019
cttgtcactgcccagtgtcatgttatcgggcagagactaccaacatttgtctacagtgagcattttcatacttctatacacagacaaggggaaactttcatccccacgcaggatatagctttttgctctgcagagtctaacttttgcaagtggaagcttcatggtggtggcggaggacctgagtgccctgaggatggcagaggacagctgtgtggatgcagatctcccagattgtaactgcgatgtcacaagggtgaagaagctgaaggagaccctggtagccgtgcagcagcttgataagaacatgagcagcctgaggacctggctcgctcacatcgagtcagagctggccaagccaatagtctacgattcctgtaactcggaagaaatacagagaaagcttaatgagcagcaggagcttcagagagacatagagaagcacagtacaggtgttgcatctgtcctcaacctgtgtgaagtcctgctgcacgactgtgacgcctgtgccactgatgccgagtgtgactctatacagcaggctacgagaaacctggaccggcggtggagaaacatttgtgctatgtccatggaaaggaggctgaaaatcgaagagacgtggcgattgtggcagaaatttctggatgactattcacgttttgaagattggctgaagtcttcagaaaggacagctgcttttcccagctcttctggggtgatctatacagttgccaaggaagaactaaagaaatttgaggctttccagcgacaggtccacgagtgcctgacgcagctggaactgatcaacaagcagtaccgccgcctggccagggagaaccgcactgattcagcatgtagcctcaaacagatggttcacgaaggcaaccagagatgggacaacctgcaaaagcgtgtcacctccatcttgcgcagactcaagcattttattggccagcgtgaggagtttgagactgcgcgggacagcattctggtctggctcacagagatggatctgcagctcactaatattgaacatttttctgagtgtgatgttcaagctaaaataaagcaactcaaggccttccagcaggaaatttcactgaaccacaataagattgagcagataattgcccaaggagaacagctgatagaaaagagtgagcccttggatgcagcgatcatcgaggaggaactagatgagctccgacggtactgccaggaggtcttcgggcgtgtggaaagataccataagaaactgatccgcctgcctctcccagacgatgagcacgacctctcagacagggagctggagctggaagactctgcagctctgtcggacctgcactggcacgaccgctctgcagacagcctgctttctccacagccttcctccaatctctccctctcgctcgctcagcccctccggagcgagcggtcaggacgagacaccccggctagtgtggactccatccccctggagtgggatcacgactatgacctcagtcgggacctggagtctgcaatgtccagagctctgccctctgaggatgaagaaggtcaggatgacaaagatttctacctccggggagctgttggcttatcaggggaccacagtgccctagagtcacagatccgacaactgggcaaagccctggatgatagccgttttcagatacagcaaaccgaaaatatcattcgcagcaaaactcccacggggccggagctagacaccagctacaaaggctacatgaaactgctgggcgaatgcagtagcagtatagactccgtgaagagactggagcacaaactgaaggaggaagaggagagccttcctggctttgttaacctgcatagtaccgaaacccaaacggctggtgtgattgaccgatgggagcttctccaggcccaggcattgagcaaggagttgaggatgaagcagaacctccagaagtggcagcagtttaactcagacttgaacagcatctgggcctggctgggggacacggaggaggagttggaacagctccagcgtctggaactcagcactgacatccagaccatcgagctccagatcaaaaagctcaaggagctccagaaagctgtggaccaccgcaaagccatcatcctctccatcaatctctgcagccctgagttcacccaggctgacagcaaggagagccgggacctgcaggatcgcttgtcgcagatgaatgggcgctgggaccgagtgtgctctctgctggaggagtggcggggcctgctgcaggatgccctgatgcagtgccagggtttccatgaaatgagccatggtttgcttcttatgctggagaacattgacagaaggaaaaatgaaattgtccctattgattctaaccttgatgcagagatacttcaggaccatcacaaacagcttatgcaaataaagcatgagctgttggaatcccaactcagagtagcctctttgcaagacatgtcttgccaactactggtgaatgctgaaggaacagactgtttagaagccaaagaaaaagtccatgttattggaaatcggctcaaacttctcttgaaggaggtcagtcgtcatatcaaggaactggagaagttattagacgtgtcaagtagtcagcaggatttgtcttcctggtcttctgctgatgaactggacacctcagggtctgtgagtcccacatcaggaaggagcaccccaaacagacagaaaacgccacgaggcaagtgtagtctctcacagcctggaccctctgtcagcagtccacatagcaggtccacaaaaggtggctccgattcctccctttctgagccagggccaggtcggtccggccgcggcttcctgttcagagtcctccgagcagctcttccccttcagcttctcctgctcctcctcatcgggcttgcctgccttgtaccaatgtcagaggaagactacagctgtgccctctccaacaactttgcccggtcattccaccccatgctcagatacacgaatggccctcctccactctgaactaagcagatgccatctgcagaagtgctggtagcataaggaggatcgggtcataagcaatcccaaactaccaacaagaggaccttgatcttggcgaaagccctcggtgtggcagctttagccctcctccagatcacatgtgtgcaaattatggcttcagaggtggaagataaacagtgacgggggaacaaacagacaacaagaaggtttggaagaaatctggtttgagactctgaaccttagcactaaggagattgagtaaggacctccaaagttccccggactcatgaattctgggcccttggcccattctgtgcacagccaaggacttcagtagaccatctgggcagctttcccatggtgctgctccaaccatcagataaatgaccctcccaagcaccatgtcagtgtcgtacaatctaccaaccaaccagtgctgaagagattttagaaccttgtaacatacaatttttaagagcttatatggcagcttcctttttaccttgttttcctttggggcatgatgttttaacctttgctttagaagcacaagctgtaaatctaaaaggcacttttttttagaggtataaagaaaaactagatgtaataaataagatcatggaaggctttatgtgaaaaaagttgaatgttatagtaaaaaaaaaaagatatttatgtatgtacagtttgctaaagccaagttttgtttgtattgatttctttgcatttattatagatattataaaata

SEQ ID NO: 185319 - DNA, 2850 bp, Homo sapiens
  Payload ID: 16494
  Gene Symbol: SYNE1
  Gene Name: spectrin repeat containing, nuclear envelope 1
  ENST ID: ENST00000537750
  CDS Start-End: 1005-2850
gaatgctaccaggcaacaccaagatctcttacaccacgagaaggacttgtggccaaagatacaaatggctccgcaatgtacagggtgcatacagtgcacctgaagaacctaaaagtggtttttagaatcatcataataaacagtcaagaattaaagatgtcaagcgctttctcaagaagtctaaactttatacataacattaaaaaagatctataaagcctgaccagtctccctcaaattaagttatttgctactgacttggcagccaaaacgatttaggatctttcggaagttgatgaaaaaggagccagcgggttttgctctttgctctgcatcacgcccttcctgggaccatcagggaacctcccagcctttcaggataggttccgctcagaaaggtcacccgggcagtggaaaccgtgggcaaaagttagctggcaggacagcgcagctcctccaggcagcggaggcagcgcgtcccggctctcagggacatttccttcccacctcgacccccgggaggtggtcccggtataaaggctcgctgagcgggtgggtcacagcacagctttgcagctgcggagaaacgcccaaggccgtgcatctccaggagggcggctgggctcccgcagtcctgcagaccgcgcccgatcccggcgacagggcgggcggacagccgcgcatccccggggtcccgccgagcctgggcgcagagagccgggaggaagcgttcgctcgcttcgccttgctgctgggaaactgaacgaggccgagagagaaggttcttgagttcatgtaagaggacagtcttaaaacggaagaagaaaaagaagcagttcagtctttgggagagctgcctccttgttgagtgctgcaaaggcctggaattcatttatgacagaatagatctagaaaagtccaagcatgttttctagagtggtgtagccctgtgctgcctccagtgaagagtctcttggtgttggcttcgtgcttccggagggaccatggcaacctccagaggggcctcccggtgtcctcgggatatcgccaatgtgatgcagaggctgcaagatgagcaagagatagtacaaaaacgaactttcacaaaatggatcaactctcatctggccaagcggaaacctccaatggtggtggacgatctttttgaagacatgaaagatggtgttaaactgcttgcccttctggaggtcctgtctgggcagaaactgccttgtgaacaaggacgccggatgaagcgaatccatgctgtggctaacattggcacggcactcaagttcctcgaaggaagaaagattaaattagtcaacattaactccaccgatatagctgatggccgaccctcaatagttcttggattgatgtggaccattattctatatttccagattgaagagttgaccagcaacctgccccagctccagtctttgtccagcagcgcatcctccgtggacagcatagttagctctgagactcccagcccaccaagtaaacggaaggtgaccaccaagatccaaggaaatgctaagaaggctttattaaagtgggttcagtacacagctggcaagcagactggaatagaagtaaaagattttgggaagagttggagaagcggggttgcctttcattcagttattcatgccattcgaccggaattggtggacttggagacagtgaaaggcagatccaaccgagaaaatttggaggatgctttcactatcgccgaaacagaactggggatcccaagactgctagatcctgaagacgttgatgtggataaaccagatgagaaatctattatgacctatgtagcccagtttctgaaacattatcctgacatccacaatgcaagcactgatgggcaagaggatgatagagaagacagagtaatttttaaggaaatgaaagtttggatagaacaatttgagagagatttgacaagagcacagatggtggaatcaaatttacaggataaatatcagtcatttaagcacttcagagttcaatatgaaatgaagaggaaacagattgaacatttaatacaaccattacacagagacggtaaattgtcacttgaccaagcattggtaaaacaatcttgggatagagtgacctccaggctctttgactggcatatacagcttgataaatctcttcctgcacctctgggcaccataggtgcctggctgtacagagcggaggtggccctgagagaggaaataaccgttcaacaggtccacgaggaaacagcaaacacgatacaacggaaacttgagcaacataaggatctgcttcaaaacacggatgcccacaaaagagcattccatgaaatctaccggaccaggtctgttaacgggattccagtgccacctgatcaattagaggacatggccgagaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctg

SEQ ID NO: 185320 - DNA, 630 bp, Homo sapiens
  Payload ID: 16494
  Gene Symbol: SYNE1
  Gene Name: spectrin repeat containing, nuclear envelope 1
  ENST ID: ENST00000469439
  CDS Start-End: 1-622
caaagagaaagcgaaagggatccaggccaaagttacagctgcaaaagaagattggaaaaattttcattcaaatctccaccaaaaagaatctgctctagagaatctaaagatccaaatgaaggactttgaagtaagtgctgagcctatccaggactggctgagtaaaactgagaagatggtccatgaaagcagcaatcgcctctatgatctgccagcaaagaggagggagcagcagaagctccaggagaaagtgtcaagactggatagaatcgttgcagaacacaatcagttctctcttgggattaaagaattacaagactggatgacggatgcgattcacatgctggattcatactgccacccgacatccgacaaaagtgtgctggacagcaggacgctcaagctcgaggtgtgcatctttacacagaaatatctccaacctacagaatttgtttttctcaaaatttcccgtctccatccacctggggtgatgatgtcacattctctccatgataaatctcagatgctttgtgagtgcaacgctgtctgccttgggtgcacatgccagagaattcctgaatcatctgaccccggatgttttccaaaaaataaaataaaataaagcccgaa

SEQ ID NO: 185321 - DNA, 647 bp, Homo sapiens
  Payload ID: 16494
  Gene Symbol: SYNE1
  Gene Name: spectrin repeat containing, nuclear envelope 1
  ENST ID: ENST00000537033
  CDS Start-End: 62-647
gaagatgaacgctactacttctgtttccttttgatgctgctctgacaccccggtgggggaaatgtttcctcaggagctggcgcagaaaattaagggctaccaggagcagatcgcttctttgaattccaagtgcaagatgctgacgatgaaagccaagcacgccaccatgctgctgacggtgaccgaggtcgaggggctggcggaagggacagaggacctggatggggagctcctccccacgccttcggcccacccctctgtggtcatgatgactgcaggtcgctgtcacactttgctgtcaccggtcactgaggagtctggggaggagggaaccaacagtgagatttcctctccacctgcctgtcgctccccttcacctgtggctaatacagatgcttctgttaaccaggacattgcatattaccaagccttgtctgctgagaggttgcagacagatgctgcaaaaattcaccccagcacatccgcatcccaggagttctatgaaccgggattggagccatccgctactgccaaactgggtgatttgcagcgttcttgggaaaccttaaagaatgtgatcagtgagaagcagcgcacactctatgaagctttggaacgccagcagaagtaccaggactccctccagt

SEQ ID NO: 185322 - DNA, 2610 bp, Homo sapiens
  Payload ID: 16494
  Gene Symbol: SYNE1
  Gene Name: spectrin repeat containing, nuclear envelope 1
  ENST ID: ENST00000466159
  CDS Start-End: 153-2417
gctgcctccttgttgagtgctgcaaaggcctggaattcatttatgacagaatagatctagaaaagtccaagcatgttttctagagtggtgtagccctgtgctgcctccagtgaagagtctcttggtgttggcttcgtgcttccggagggaccatggcaacctccagaggggcctcccggtgtcctcgggatatcgccaatgtgatgcagaggctgcaagatgagcaagagatagtacaaaaacgaactttcacaaaatggatcaactctcatctggccaagcggaaacctccaatggtggtggacgatctttttgaagacatgaaagatggtgttaaactgcttgcccttctggaggtcctgtctgggcagaaactgccttgtgaacaaggacgccggatgaagcgaatccatgctgtggctaacattggcacggcactcaagttcctcgaaggaagaaagattaaattagtcaacattaactccaccgatatagctgatggccgaccctcaatagttcttggattgatgtggaccattattctatatttccagattgaagagttgaccagcaacctgccccagctccagtctttgtccagcagcgcatcctccgtggacagcatagttagctctgagactcccagcccaccaagtaaacggaaggtgaccaccaagatccaaggaaatgctaagaaggctttattaaagtgggttcagtacacagctggcaagcagactggaatagaagtaaaagattttgggaagagttggagaagcggggttgcctttcattcagttattcatgccattcgaccggaattggtggacttggagacagtgaaaggcagatccaaccgagaaaatttggaggatgctttcactatcgccgaaacagaactggggatcccaagactgctagatcctgaagacgttgatgtggataaaccagatgagaaatctattatgacctatgtagcccagtttctgaaacattatcctgacatccacaatgcaagcactgatgggcaagaggatgatgaaatacttccaggtttcccatcttttgcaaattctgtacaaaattttaagagagaagacagagtaatttttaaggaaatgaaagtttggatagaacaatttgagagagatttgacaagagcacagatggtggaatcaaatttacaggataaatatcagtcatttaagcacttcagagttcaatatgaaatgaagaggaaacagattgaacatttaatacaaccattacacagagacggtaaattgtcacttgaccaagcattggtaaaacaatcttgggatagagtgacctccaggctctttgactggcatatacagcttgataaatctcttcctgcacctctgggcaccataggtgcctggctgtacagagcggaggtggccctgagagaggaaataaccgttcaacaggtccacgaggaaacagcaaacacgatacaacggaaacttgagcaacataaggatctgcttcaaaacacggatgcccacaaaagagcattccatgaaatctaccggaccaggtctgttaacgggattccagtgccacctgatcaattagaggacatggccgagaggtttcattttgtttcctccacatcagagctacacctaatgaaaatggaatttttagaattaaagtaccgtctgctctcactgctggttcttgcagagtcaaagctgaagtcttggatcattaagtacgggaggagagagtcagtggagcagcttctacaaaactacgtgtcttttatagaaaatagcaagttctttgaacaatatgaggtgacataccagatcttgaaacagacagctgagatgtatgtcaaagcagatggttcagtggaagaagctgagaatgtgatgaaattcatgaatgaaaccaccgctcagtggaggaatctctcagtagaagtgaggagtgtgaggagcatgctggaagaagtgatctctaactgggatcgctatggcaatacagtggctagtctgcaagcctggctagaggatgctgaaaaaatgctcaatcaatcagaaaatgccaaaaaggatttttttcgaaatttacctcattggattcagcagcatactgccatgaacgatgctggcaattttctaattgaaacctgtgatgagatggtttcccgtgacctgaagcagcaattactgttgctaaatgggcggtggagggagttgtttatggaagtcaagcaatatgctcaagctgatgagatggacagaatgaagaaggaatacacagactgtgttgttaccctgtctgcttttgcaacggaagcccataagaaactttctgaacccttagaagtctcttttatgaatgtcaagctattaattcaagacttggaggtgaggggtttctgaatcaaaatgaaaagcctactctgttgtgagaggaaagatcagcaagtttattcagatcattgcaaaagctgtttctgtgtctcctgggcatcattttgacatgtctgtatgtcccaatttgcacctgtcagaaaaaaatgtattgaacataaaaaagacatgacttgatcatataaagtaacttcaaattgtt

SEQ ID NO: 185323 - DNA, 1754 bp, Homo sapiens
  Payload ID: 16494
  Gene Symbol: SYNE1
  Gene Name: spectrin repeat containing, nuclear envelope 1
  ENST ID: ENST00000610489
  CDS Start-End: 321-1754
tcgcttcgccttgctgctgggaaactgaacgaggccgagagagaaggttcttgagttcatgtaagaggacagtcttaaaacggaagaagaaaaagaagcagttcagtctttgggagagctgcctccttgttgagtgctgcaaaggcctggaattcatttatgacagaatagatctagaaaagtccaagcatgttttctagagtggtgtagccctgtgctgcctccagtgaagagtctcttggtgttggcttcgtgcttccggagggaccatggcaacctccagaggggcctcccggtgtcctcgggatatcgccaatgtgatgcagaggctgcaagatgagcaagagatagtacaaaaacgaactttcacaaaatggatcaactctcatctggccaagcggaaacctccaatggtggtggacgatctttttgaagacatgaaagatggtgttaaactgcttgcccttctggaggtcctgtctgggcagaaactgccttgtgaacaaggacgccggatgaagcgaatccatgctgtggctaacattggcacggcactcaagttcctcgaaggaagaaagtccatgcacagaggatcaccgattaaattagtcaacattaactccaccgatatagctgatggccgaccctcaatagttcttggattgatgtggaccattattctatatttccagattgaagagttgaccagcaacctgccccagctccagtctttgtccagcagcgcatcctccgtggacagcatagttagctctgagactcccagcccaccaagtaaacggaaggtgaccaccaagatccaaggaaatgctaagaaggctttattaaagtgggttcagtacacagctggcaagcagactggaatagaagtaaaagattttgggaagagttggagaagcggggttgcctttcattcagttattcatgccattcgaccggaattggtggacttggagacagtgaaaggcagatccaaccgagaaaatttggaggatgctttcactatcgccgaaacagaactggggatcccaagactgctagatcctgaagacgttgatgtggataaaccagatgagaaatctattatgacctatgtagcccagtttctgaaacattatcctgacatccacaatgcaagcactgatgggcaagaggatgatgaaatacttccaggtttcccatcttttgcaaattctgtacaaaattttaagagagaagacagagtaatttttaaggaaatgaaagtttggatagaacaatttgagagagatttgacaagagcacagatggtggaatcaaatttacaggataaatatcagtcatttaagcacttcagagttcaatatgaaatgaagaggaaacagattgaacatttaatacaaccattacacagagacggtaaattgtcacttgaccaagcattggtaaaacaatcttgggatagagtgacctccaggctctttgactggcatatacagcttgataaatctcttcctgcacctctgggcaccataggtgcctggctgtacagagcggaggtggccctgagagaggaaataaccgttcaacaggtccacgaggaaacagcaaacacgatacaacggaaacttgagcaacataagaaaatagaagcaatcagaaaagaattgccaccagctcccacggccacatcaacccacctacgcaattgcatctgtgcccgaatacacgctcttcacttctgttactatgggtga

SEQ ID NO: 185324 - DNA, 21777 bp, Homo sapiens
  Payload ID: 16495
  Gene Symbol: SYNE2
  Gene Name: spectrin repeat containing, nuclear envelope 2
  Uniprot ID: Q8WXH0
  ENST ID: ENST00000344113
  CDS Start-End: 213-20870
gccaaggagcggagcgcgctcagctgcgcccagagccttcggccggacctgaaaaagcgagagggagagcgagcaaaaggcgcgatccagagagccaggcaagcggggcgccgacctcgggcggccccggcccgcgcccttgcccctcggccgggcggacgttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaatggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaactaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagcggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacagcattctcaaatcaaaacgctcaacagaaaagaaaggaaagtttactctgccaggcagagagaagcaggccacttctgatgtgcaggagtctactcaggaatcagctgcagtggaaaagttggaggaagactgggaaataaacaaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcagtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaagataaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcattcaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatgatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacacatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccaga

SEQ ID NO: 185325 - DNA, 1132 bp, Homo sapiens
  Payload ID: 16495
  Gene Symbol: SYNE2
  Gene Name: spectrin repeat containing, nuclear envelope 2
  Uniprot ID: Q8WXH0
  ENST ID: ENST00000341472
  CDS Start-End: 204-1061
cggagcgcgctcagctgcgcccagagccttcggccggacctgaaaaagcgagagggagagcgagcaaaaggcgcgatccagagagccaggcaagcggggcgccgacctcgggcggccccggcccgcgcccttgcccctcggccgggcggacgttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgcctggagaagttctgcactttacagaatttatatgcctggcacagtgtcttgtgccagctacttgtgaggctgagattggaggactgtttgaggccaggagtttgagaccagactggacaacatagagagaccctgtct

SEQ ID NO: 185326 - DNA, 21555 bp, Homo sapiens
  Payload ID: 16495
  Gene Symbol: SYNE2
  Gene Name: spectrin repeat containing, nuclear envelope 2
  ENST ID: ENST00000357395
  CDS Start-End: 213-20687
gccaaggagcggagcgcgctcagctgcgcccagagccttcggccggacctgaaaaagcgagagggagagcgagcaaaaggcgcgatccagagagccaggcaagcggggcgccgacctcgggcggccccggcccgcgcccttgcccctcggccgggcggacgttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaatggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaactaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagcggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacagcattctcaaatcaaaacgctcaacagaaaagaaaggaaagtttactctgccaggcagagagaagcaggccacttctgatgtgcaggagtctactcaggaatcagctgcagtggaaaagttggaggaagactgggaaataaacaagaattttgttgaaaatgtgatggcagtttccaaaaattgccatcatagcatgtatatatttgaatccattgtcaagaatttcatttcagatgaaatgcaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcagtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaagataaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcattcaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatgatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacacatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgatcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcaggtcagcctttttgggggtttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctgaacgcccatgtagccaggtgtggtggcgcatctcttaaaaaacaggaccttcgctactctctgcacactgcctgcggagcggccctgctctgcaggagcagtcacggagctaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaagagaacagttggaagagaggaggttccagagagatgggagtgtgagaccattgtcagtgggcatggtaccgaggagagttgctttctctccattagaaagtttcaccagggaaggggcttacatatccttacatgtcagctgataccccaagactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagtatggcagatcagacaaactccaggtggatgttttttcagtggccacgtggcatacagcgaaccgtcacttggccttgggaccacttgtgcagctgtgcttccactggccacacgggtcctttccatagcagtgtgctcagatgttttgaacaacacatagaatttggaatatacaggagaacctataaggtgaataaagaattgggaggtgataaaaacggacagagatgccccataatctacccgcatgggctggttcaatgtatacggctgggtgaacccctcatactgaagcgggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggagggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatgtaagtcttaacttcactgggagtacagcctatgtctgtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagtttctttacccagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccag

SEQ ID NO: 185327 - DNA, 21842 bp, Homo sapiens
  Payload ID: 16495
  Gene Symbol: SYNE2
  Gene Name: spectrin repeat containing, nuclear envelope 2
  Uniprot ID: Q8WXH0
  ENST ID: ENST00000358025
  CDS Start-End: 213-20936
gccaaggagcggagcgcgctcagctgcgcccagagccttcggccggacctgaaaaagcgagagggagagcgagcaaaaggcgcgatccagagagccaggcaagcggggcgccgacctcgggcggccccggcccgcgcccttgcccctcggccgggcggacgttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaatggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaactaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagcggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacagcattctcaaatcaaaacgctcaacagaaaagaaaggaaagtttactctgccaggcagagagaagcaggccacttctgatgtgcaggagtctactcaggaatcagctgcagtggaaaagttggaggaagactgggaaataaacaaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcagtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaagataaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcattcaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatgatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacacatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccag

SEQ ID NO: 185328 - DNA, 11095 bp, Homo sapiens
  Payload ID: 16495
  Gene Symbol: SYNE2
  Gene Name: spectrin repeat containing, nuclear envelope 2
  Uniprot ID: Q8WXH0
  ENST ID: ENST00000394768
  CDS Start-End: 379-10191
tgctgcttgcagctttttagatcaggactgcaatggagatacaattaaatcctaaaggtactttagaagcagggggtgttgtaatgtcttttctagataatggtgtgacactatgaagagatatcaagtttaattcttacaaattagaaagcatcatctgactaaactgagtgtctctggggcttaatcagcttgtatcactagtggggttttgtcatgcaaactgcactcctttaaatcataaggatgtgctggaaggctgctttcactttttagaattaaacttttcccccagtctcgtgagtattgcaactctcttaatgcttttaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcaggattccaagtgttttagaagtggaccaagaccaaatatttatgtttcttattatgttacagttatacagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagcc

SEQ ID NO: 185329 - DNA, 2669 bp, Homo sapiens
  Payload ID: 16495
  Gene Symbol: SYNE2
  Gene Name: spectrin repeat containing, nuclear envelope 2
  Uniprot ID: Q8WXH0
  ENST ID: ENST00000458046
  CDS Start-End: 93-1763
gcagaagcctatgagttgattaattctaacaactggatactgtggtttagggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccagggctctaagacacggccgcgctctgatgtgttgttttttaaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccag

SEQ ID NO: 185330 - DNA, 3084 bp, Homo sapiens
  Payload ID: 16495
  Gene Symbol: SYNE2
  Gene Name: spectrin repeat containing, nuclear envelope 2
  Uniprot ID: Q8WXH0
  ENST ID: ENST00000441438
  CDS Start-End: 891-2180
cgtgtctacctctgccttctgtggacaccatgcgccttggtccttgtgtcatggtgtatttacactgccgtactcacccataactgcgtgctccttacaaaaccccatccaagccagagccgtctcgatgccaaccccctctcctcccttcaggcctgtgcagagggaatttttcatggtgcctgttttgatgatttttttctccatctaactgaagtcctttggcatgggccaagctttcttcatggtggcttggtttggaactgtttccttgctttactgggatcccctggtggaaaggggtggggggttggggcggtaaagggtgctgatgatttgccacaggagggaaaaaaccttcctttccttgatttgcagctctaatcctcatccttagccccatccctatctgccatggtgggtcggggagagccctgaggagccttttggttcccaagtccatcttgatgttcactcttcccctcactcctgagaggccttctgccatcttggtccccagacccggccttgccactcagtgtccctaccactcgagaccctggctccaaaacgccactcatcccacagcaaatcatgttggtcgtgctccgttgtgtacccatctagtgaaggcacagtgttgctgagttgcatgactcatctcattctcttctgggacatactgacattttgcaaacatgcatgctttgcaaggaaagctgcagaactcattttcatactgtaacctgatgccatgtcacccgtgacccgttcagtaggagagaatagactgtcgcttgctgtctttcgtttcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccagggctctaagacacggccgcgctctgatgtgttgttttttaaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagcc

SEQ ID NO: 185331 - DNA, 3277 bp, Homo sapiens
  Payload ID: 16495
  Gene Symbol: SYNE2
  Gene Name: spectrin repeat containing, nuclear envelope 2
  ENST ID: ENST00000554805
  CDS Start-End: 367-2373
cagggtctcccccactaaaccgtgcgggtgtcaggggataaaagaagtgcaaaagcacaggcttggaggggatggcttgtgttaagttgctttgctcccatcagaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagcc

SEQ ID NO: 185332 - DNA, 689 bp, Homo sapiens
  Payload ID: 16495
  Gene Symbol: SYNE2
  Gene Name: spectrin repeat containing, nuclear envelope 2
  ENST ID: ENST00000557084
  CDS Start-End: 61-183
gcagaagcctatgagttgattaattctaacaactggatactgtggtttagggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactact

SEQ ID NO: 185333 - DNA, 11532 bp, Homo sapiens
  Payload ID: 16495
  Gene Symbol: SYNE2
  Gene Name: spectrin repeat containing, nuclear envelope 2
  ENST ID: ENST00000555002
  CDS Start-End: 1-10626
atggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtttccacaaatatgggtattctacccagcgtgactatgtataactttagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaatgaaataaagagattatatcatcagctcattaagagtaagacatctttacaacagtctttgaatgaaatcagtgggcagagtgttgctgaacagcttcagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcagatgtagaaatccctgaaaatcctgaggcatatcttaaaatgaccacaaaaactttgaaagcgtcttctggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccag

SEQ ID NO: 185334 - DNA, 3396 bp, Homo sapiens
  Payload ID: 16495
  Gene Symbol: SYNE2
  Gene Name: spectrin repeat containing, nuclear envelope 2
  Uniprot ID: Q8WXH0
  ENST ID: ENST00000555022
  CDS Start-End: 201-2492
ggcaaggccttgcaaataacaatttaccctgagtggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagcc

SEQ ID NO: 185335 - DNA, 5261 bp, Homo sapiens
  Payload ID: 16495
  Gene Symbol: SYNE2
  Gene Name: spectrin repeat containing, nuclear envelope 2
  ENST ID: ENST00000553289
  CDS Start-End: 110-1822
ggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagccag

SEQ ID NO: 185336 - DNA, 557 bp, Homo sapiens
  Payload ID: 16495
  Gene Symbol: SYNE2
  Gene Name: spectrin repeat containing, nuclear envelope 2
  ENST ID: ENST00000553308
  CDS Start-End: 41-557
attcttgtgctgtgcctttcagttgaacagaagaggctccatgtcttacctggcagcagtcgaggaagaggtggaagaaagttccgtgaagagcgataatggagatgagaaggcagagccatcgcctcagtcttggtcttcactttggaagcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccagg

SEQ ID NO: 185337 - DNA, 6766 bp, Homo sapiens
  Payload ID: 16495
  Gene Symbol: SYNE2
  Gene Name: spectrin repeat containing, nuclear envelope 2
  ENST ID: ENST00000555612
  CDS Start-End: 42-3383
cactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctggtgaggcagtggcaagatttcactacttctgtggagaacttgtttcgcttcctcactgacaccagccacctgctatctgcagtgaagggccaggagcgcttcagcctctaccaaaccagaagtctgatccatgagctgaagaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggaactagaacagtctttggctagctggactcagaacttgaaagaacttcaaactatgaaggcggacttaacccggcacgttctcgtggaagatgtgatggttttgaaggagcaaatagagcatttgcacagacaatgggaggacctctgcttaagggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaaggactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcagcccacccatggggtacagcagaaatattatctgatgatgactaaaaatgccatgtttattcgtgaagaggttttccagttttttcctatgaccatgcattttctcttcataaatgttatttttcccaaattggggaactgcatcactatcatcatcaaaggacaagactccagagaccccacctctctccaagccaccacagctttggctggactttatcagttggggaggcaaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggaggtgtttggaagggtctcccggttccaccggcggctcacctcctgcactccgggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatggaaagctactattacctccaggcacggatggtggcaaagaaggcccgcgagtcctgaatggcaacccacagcaggaagacgggggactggccggtatcacagagcagcagtcaggtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccagggctctaagacacggccgcgctctgatgtgttgttttttaaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctgattgccaagggtgcccagcacgtggccccagaccaatctgagtgacttagtgttggcaaggtcccgggacctgtgcagacttcttctgggcttacccagcacgggctccctggagcccagggcagctttcagattgtgttcctccccaggagcagggaacctgtgtggcaggtgccccgggtattttggcagaactagttgattagtttagggatctctggaaatgtcagtttcctgaagagccaagcactttgtgaattctggtttgtttgtaaaacagcattattataatgtaggtatggtcaatgagcagtggtgtccatcacatatattatagaagcaagcgaggacattccaccctagaaatggttcagaaactcataggcacccttagctgatggaaacaatcaatcatatttaatacgcttagaatcagttttactccaatcagctggcaattttgagctgccggttatacaccaaaatgttctgttcagtacctagctctgctcttttatattgctttaaatttttaaagaaattgtattgcatggatgtggttatttgtgcatattttttaacaatgcccaatctgtatgaataatgtaaacttcgatttttttttaaaaaaattagattttagctggagcttttgactaatgtaaagtaaatgccaaactaccgacttgatagggatgtttttgtaagttaattttctaagactttttcacatccaaagtgatgctttgctttgggttttaactgtttggccacggcgggggtgggggcggggggttggtacagaaacttgaagctgtttgtgatatgtacaactcagatgtttctcattaaaaaacaaaattagcc

SEQ ID NO: 185338 - DNA, 574 bp, Homo sapiens
  Payload ID: 16495
  Gene Symbol: SYNE2
  Gene Name: spectrin repeat containing, nuclear envelope 2
  ENST ID: ENST00000556906
  CDS Start-End: 89-574
agagatgccccataatctacccgcatgggctggttcaatgtatacggctgggtgaacccctcatactgaagcgcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgaggcctttcagcggcagattcatgagcggctcactcag

SEQ ID NO: 185339 - DNA, 674 bp, Homo sapiens
  Payload ID: 16495
  Gene Symbol: SYNE2
  Gene Name: spectrin repeat containing, nuclear envelope 2
  ENST ID: ENST00000553455
  CDS Start-End: 1-645
atgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagcaaccaggcatccagccctgaaaatgacgttccagactcgatcttgtcaccccagggccaaaatggagataagtggcaatatctgcatcatgaactctcatcaaaaataaagctcccactccctcagcttgtggagcctcaggtcagtctgtatctacatggtgcaaatagcctgtttatctttgaaaatccaacaagcattcattaaataaacatgtatattctccagaaagcaaa

SEQ ID NO: 185340 - DNA, 20508 bp, Homo sapiens
  Payload ID: 16495
  Gene Symbol: SYNE2
  Gene Name: spectrin repeat containing, nuclear envelope 2
  ENST ID: ENST00000554584
  CDS Start-End: 52-20508
ttcacttcttcaactgagatggacatgatataatctccattgagtcaaagaatggcatctagtcctgagcttcccaccgaagatgaacagggttcctggggcatcgacgatctccatatttcattgcaagctgaacaggaagacacccagaagaaagccttcacgtgctggataaactcacagttggccaggcacacttctccctcagttatatccgacctattcacagacattaaaaaggggcatgtcctcctggatctgctagaagtactttctgggcaacagttgcctcgggataaaggatctaataccttccagtgtagaatcaatatagaacatgccttgacattcctaagaaaccgatcaattaagctaataaatattcatgttactgatatcattgatggaaacccatccattatccttggcctaatttggacaattatcctgcactttcatattgagaagcttgcccagactctttcttgcaattacaatcagccttccctggatgatgtgagtgtggttgactcatctcctgcctcaagtcctccagctaagaaatgctctaaagtgcaagcaagatggcaaatgtctgcaagaaaggcccttcttttgtgggctcaggaacaatgcgccacctatgagtctgtcaatgtgaccgattttaagtcaagttggagaaatgggatggcttttttggccatcattcatgccttgcgaccagacctaattgacatgaagagtgtgaagcatagatccaacaaagacaatctgagagaggccttcagaattgcagaacaagaattaaaaatccccagattgctggaaccagaagatgtggatgttgttgatcctgatgaaaagtccatcatgacctatgtggcacagtttctgcagtattccaaagatgcccctgggactggagaggaggctcagggaaaggtgaaagatgctatgggctggttaactctgcaaaaggaaaaactacagaagttgctaaaggattcagagaatgatacctactttaaaaagtataatagcctgctgtcctttatggagtcattcaatgaagaaaaaaagtcctttttggatgtcctgtcaataaaacgggatctggatgagctggacaaggatcatttacagttgagagaagcctgggatggcctcgatcaccagattaatgcatggaaaataaagctaaattatgccttgcccccacccctccatcaaactgaagcttggctccaggaggtagaagagcttatggatgaagatttgtcagcctcccaggatcactctcaagccgtgactctgatacaagagaaaatgactttattcaagagcctgatggatagatttgagcatcattcgaacattctccttacctttgaaaataaggatgaaaatcacttgccattggtaccacctaacaaattggaggaaatgaaaagacgaatcaacaacattttggagaaaaaatttattctacttctagaatttcattactacaagtgcttagttcttggtttggtagatgaagtgaaatcaaaattggatatttggaacattaaatatgggagcagagaatctgtggaattattgctggaagactggcataaatttattgaagaaaaagaattcctagctcgacttgatacttcttttcaaaaatgtggagaaatttataagaatttggctggagaatgtcagaatattaataaacagtatatgatggtgaaatctgatgtttgtatgtatagaaaaaatatatataatgtgaagtccactctacaaaaagtgctggcatgttgggctacttatgtggaaaaccttcgcttactaagggcttgctttgaggagacaaagaaggaagaaattaaagaggtaccctttgagacactagcccagtggaatctagaacacgctactttaaatgaagcaggaaatttcttagtcgaagtcagcaatgatgtggttggatcatctatttctaaagaactgagaaggctgaataaaagatggagaaagttggtttcaaaaactcaacttgaaatgaacctgccactgatgataaaaaaacaggatcagcccacttttgacaattctggaaatattctatctaaagaagagaaagcaactgttgagttttcaacagatatgtcagtagaacttcctgaaaattataatcaaaatataaaggctggagagaaacatgaaaaagaaaatgaagaattcacagggcaactaaaagtggctaaagatgttgaaaaactcattggacaagtggaaatctgggaggcagaagccaaatctgttttggatcaagatgatgtggacacctcaatggaagaatctttgaagcatcttattgccaaaggctctatgtttgatgagcttatggcaagaagtgaagatatgttacaaatggatatacaaaatatttcaagccaggagtcctttcaacatgttctcacaactgggcttcaggcaaagattcaagaagctaaagagaaagtccagatcaatgtggtaaaactcattgcagcgttgaagaacttaactgacgtttcaccagatttggacatcaggctgaagatggaagaatcccagaaggaacttgaatcatatatgatgagggctcagcagttactggggcaaagagagagccccggtgaactcatttcaaaacacaaggaagcactaataatttctaatacaaaaagtctggccaagtatttgaaagctgttgaagaactaaaaaataatgtaactgaggacataaagatgtctttagaagaaaagagtagagatgtctgtgccaaatgggagtctcttcatcatgaactgtctttatatgttcaacaactaaaaatagatattgaaaaaggaaagcttagtgacaatattttaaaacttgaaaagcaaataaataaagaaaagaaacttatccgtagaggaaggaccaagggtctcatcaaagaacatgaggcctgcttttctgaggaaggctgcctgtaccagcttaatcaccacatggaagtcctgagggagctgtgtgaagagctgccttcacagaagagtcaacaagaagtgaagagactactcaaagattatgaacaaaagatagaaagacttctgaaatgtgcttccgagattcatatgacactgcagcccacagcgggaggcacgtcgaaaaacgaggggaccatcaccacatctgagaatagaggaggggatccccacagtgaggcaccatttgcaaaatcagataatcagccatcaactgaaaaggcaatggaacccactatgaagtttagcctggcatcagtgttaaggcctctgcaagaagaaagcattatggaaaaggattacagtgcatctataaatagtttactagagaggtatgatacatacagagatattcttgaacaccacctgcaaaacaacaaattcaggattacttctgatttctctagtgaagaggacaggagtagttcttgtctgcaggctaaactgacagatctacaggtcataaaaaatgaaactgatgctcgctggaaagagtttgaaattatttcattgaagttagaaaatcatgtgaatgacataaaaaagccttttgtaattaaggaaagagacacactaaaggaaagagaaagagagcttcagatgactcttaataccagaatggaatctttagagacagcactgcggcttgtgttacctgtagagaaggcatcacttcttctctgtggctcggacctgcctctccataaaatggccatccagggatttcatctcattgatgctgatcgcatctatcaacacctaaggaatatccaagattccatagcaaaacagattgaaatatgtaaccgcttagaagagccaggcaactttgtattaaaggagttacacccatttgatctacacgcaatgcagaatattatactgaaatacaaaacacaatttgaaggaatgaaccacagggtgcagaggagtgaagatactctcaaagctctggaagactttttggcgtctctcagaacagctaaactctctgctgagcccgttacagacctttcagcctcagatacacaggtggcacaagaaaatacgttgacagtaaaaaataaagagggagaaattcatctgatgaaagacaaggccaaacatttggataaatgtttgaagatgctcgatatgagctttaaagatgctgaacggggtgatgacacctcctgtgaaaacctgcttgatgctttttcaataaagttatctgagacacatggctatggggtacaggaggaattcactgaggaaaacaaattactagaggcttgtattttcaaaaataatgaactccttaaaaatattcaagatgtgcagagtcaaatcagtaaaattggtcttaaggatcctactgttccagctgtgaaacatcggaaaaaatcattaatcagactggataaggttctagatgaatatgaagaagagaagagacatttacaagaaatggctaattctcttccacacttcaaagatggcagagaaaaaaccgtgaatcaacagtgccaaaatacagtagtcttgtgggagaataccaaagccttggtcaccgaatgtcttgaacaatgtgggagagttttggagctcttaaaacaatatcagaattttaaaagcatcttgacaactttgattcaaaaagaagagagtgtcatctccctgcaggcttcgtacatgggaaaggagaacctgaagaaaaggatagcagagattgaaattgtcaaagaagaatttaatgagcatttagaagttgtagacaagataaaccaggtctgcaaaaatctacaattttatctaaataaaatgaaaacttttgaagagcccccttttgaaaaagaggctaatattattgtggatagatggcttgatataaatgagaagacagaagattactatgaaaatcttggtcgagctctagctttgtgggacaaactttttaacttaaaaaatgtcattgatgagtggacagaaaaggcccttcaaaaaatggaattacatcaattgactgaagaggacagagaaaggctgaaggaagaattacaagtccatgaacaaaaaacttcagaattttctagaagagtggctgaaatacagtttttgctccaaagcagtgaaatacctcttgaattgcaggtcatggagtcctctattttgaacaagatggaacatgtacagaagtgcttaacaggagaatccaactgccatgcactcagtggcagcactgctgagctaagggaggatctcgaccaagccaagacccagatcgggatgactgaatccctcttaaaagccctgtctccttctgacagcttggagatcttcactaaactagaggagatacaacagcagattctacagcaaaaacacagtatgatattacttgagaatcaaataggttgtctgactcctgaactctctgaattgaaaaagcaatatgaaagtgtcagtgatttatttaataccaaaaaaagtgttttgcaagatcacttttctaagttattgaatgatcaatgcaagaactttaatgactggttcagcaacattaaagtgaaccttaaggagtgttttgaatcatcagaaacaaaaaagagtgtggaacaaaagctacaaaaactttctgatttcttgactcttgaaggaagaaacagtaaaataaagcaggtggacagcgtactgaagcatgtgaagaagcatctgcccaaagcacatgtgaaggagcttatcagttggctcgtgggtcaggaattcgaattagaaaaaatggagtccatatgccaggctcgagcaaaggagcttgaagactccttgcagcagctactgagactccaggatgaccatagaaacctgaggaagtggttgactaatcaagaagagaaatggaaaggaatggaagaaccaggggagaaaactgagctgttctgccaagctttagctagaaagagggaacagtttgaatctgtggcccaattgaacaactctttgaaggaatatgggtttactgaagaagaagaaataataatggaagcaacatgtttgatggatagataccagacattactgagacaactaagtgaaatcgaggaagaggataagttactacccacagaggaccagagctttaatgatcttgcacatgatgtaattcattggataaaagagattaaagagtcccttatggttttgaattcatccgaaggcaaaatgccacttgaggaaagaatccaaaaaatcaaggaaatcattttgctgaagcctgaaggggatgccagaatagagaccatcatgaagcaggctgagagcagcgaggccccgctggttcagaagaccctcactgacatcagcaaccagtgggacaacacactccatttagctagcacctacctaagccatcaagaaaagcttctactagaaggagagaaatatttacaaagtaaggaggatctgagattaatgctcatagaactaaagaagaaacaggaagcaggctttgctctacaacatggtctgcaggagaagaaagctcagttaaagatttataagaaattcctcaagaaagcccaagatttgacatccttgctaaaggagttaaaatctcagggaaactacctcttggagtgcactaaaaatcccagcttcagtgaagagccttggctggaaataaagcatctacacgaaagtcttcttcaacaactgcaggattctgtgcaaaacttggacggtcacgttcgagaacatgattcataccaggtttgcgtcacagacctgaatactacattggacaatttctccaaggaatttgtcagtttttctgataagcctgtggatcaaatagcggttgaggaaaaattgcagaaactgcaggaactagagaatagactcagtttacaagatggcacattaaagaagattttagctttagcaaaatccgtcaagcaaaatacatcttcagtggggcagaagattattaaagatgatataaaatcacttcagtgtaaacaaaaagatttggaaaacaggcttgcatctgctaagcaggagatggaatgttgtctcaacagcattctcaaatcaaaacgctcaacagaaaagaaaggaaagtttactctgccaggcagagagaagcaggccacttctgatgtgcaggagtctactcaggaatcagctgcagtggaaaagttggaggaagactgggaaataaacaagaattttgttgaaaatgtgatggcagtttccaaaaattgccatcatagcatgtatatatttgaatccattgtcaagaatttcatttcagatgaaatgcaggattcagctgtggaaatggctatgtcaaaacaactttctcttaatgctcaagaaagcatgaaaaacactgaagatgagcggaaagtcaatgagctgcaaaatcaacctttagaattagatactatgttaagaaatgaacaattagaagagatagagaaattatatacccagttggaagcaaagaaagcagccattaagccactggaacaaacagaatgtcttaacaaaacagaaactggggccttggttctccacaatataggatattcggcacagcatttggacaatttgcttcaggcacttattactttgaagaaaaacaaagaaagccaatattgtgtcctcagagattttcaggaataccttgctgcagttgaatcttcaatgaaagccttgttgacagacaaggaaagtcttaaagtaggaccactggacagtgtaacgtatctggacaaaattaaaaaattcatagcatccatagaaaaagagaaagattctttaggcaacttgaaaatcaaatgggagaatttatcaaaccacgtgactgacatggataagaaattgttggaaagccagattaagcaacttgaacatggttgggaacaagtggaacagcagattcaaaagaagtattctcagcaggtagtggaatatgatgaatttacaaccctcatgaataaggtacaggacactgagatttctctgcaacagcagcagcaacatctacagttaaggctgaagtctccagaagaacgggcagggaaccaaagcatgattgccttgaccactgacctccaggctaccaagcatggattttctgttttaaaggggcaagctgaacttcagatgaagaggatttggggagaaaaagaaaagaagaatttggaggatggaataaataacttgaagaaacaatgggaaacattggagccattacacttagaagcagaaaatcagattaagaagtgtgacataaggaacaagatgaaagagactatcttatgggccaagaatttgttgggtgaacttaatccctccattccccttctcccagatgacattctttcacagatcagaaagtgcaaagtgacacatgatggcattctagctaggcagcagtctgtggaatcgttggctgaagaggtcaaagataaggttcctagccttacaacctatgagggcagtgatttaaataataccctagaggacttacggaatcaataccaaatgctggttttaaaatcaactcaaagatcacagcaattagaatttaagttggaagaaagaagcaatttttttgctataataaggaagtttcaacttatggttcaagaaagtgaaacactgataattcccagggtggagacagctgccacggaagctgaactaaaacatcaccatgttactttggaggcatctcagaaggaattgcaagaaattgacagtggaatctcaacacatcttcaggagctaacaaacatctatgaggagctgaatgtgtttgaaagattatttctggaagatcagttgaaaaatcttaagattaggaccaacagaatacaaagattcattcagaatacatgtaatgaagtggaacacaagataaagttttgcagacaattccatgaaaaaacatcagcgcttcaggaggaggctgacagtatacagcgcaatgaactattacttaatcaagaagtaaataaaggtgttaaagaggagatctataatcttaaagacagactcaccgctattaagtgttgcatcttacaggtattgaaacttaaaaaagtgtttgactatattggactaaactgggatttttcacaacttgaccaattacaaacccaagtatttgaaaaagaaaaggaacttgaagaaaaaattaagcagttggacacatttgaggaagaacatggcaaatatcaggcattattaagtaaaatgagagctattgatttgcaaattaagaaaatgactgaagtagtactaaaagctcctgatagctctccggaaagcagacggctcaatgcccaaattttaagtcagagaattgagaaagccaagtgtttatgtgatgagataataaagaaattaaatgaaaataagacctttgatgactcattcaaggagaaagaaatactacaaataaagctgaatgcagaagaaaatgataagttatacaaagttctccaaaacatggtattagaactctcaccaaaagaattggatgaaaagaattgtcaggacaaactagaaacttccttacatgttttaaatcagataaaatctcaattacagcagccattacttataaatttggaaattaaacatattcaaaatgaaaaggacaattgtgaagcatttcaggagcaagtttgggcagaaatgtgtagtattaaagctgtgactgctattgagaaacaaagagaagaaaactcttctgaagcgagtgatgtggagacaaaactacgtgagtttgaagatcttcagatgcagcttaacacaagcattgatttgcgcacaaatgtcttgaatgatgcttatgaaaatctaacacgctataaagaagcagtcaccagggcagtggagagcatcacttccctcgaagccatcattataccctacagagtagatgttggtaatccagaagaatctttagagatgcctcttcgaaaacaagaggaattggaatccacagtagcacacatccaggacctcactgagaaactgggaatgatatccagccccgaagccaaactacaacttcagtatactttacaggaactagtttctaagaactcagcaatgaaggaagctttcaaagcacaggaaactgaggcagaaaggtatcttgagaattacaaatgctatagaaaaatggaagaggatatttacactaacctcagcaaaatggagacagttcttggacagtccatgtcctcgttgccactgtcttacagagaagctttagagcgcttggaacagagcaaggccttggtgtcaaatcttatatcaaccaaagaagagttaatgaaactacgacagatccttagactcttgagactcaggtgcacagaaaatgatggcatatgtttgctcaagattgtgtcggctctgtgggagaaatggctgagtttgctggaagctgctaaagagtgggagatgtggtgcgaagaactgaagcaggaatggaaatttgtcagtgaagaaattgaacgagaggcaattattttagataatcttcaggaagaactccctgaaatttccaaaacaaaagaggcagccaccacagaggaactctctgagctgctagactgtttatgccaatatggagagaacgtggagaagcaacagctgttactgactctacttcttcagcgcatcagaagtatccagaatgttcctgaaagctcaggggctgtggaaactgttccagcatttcaagaaattacttctatgaaagaacgatgcaacaagcttcttcagaaagttcagaaaaataaagaattggtgcagactgaaatccaagaaagacattccttcacaaaagagataattgctttgaagaatttctttcaacagaccacaacttcattccaaaatatggcattccaggatcacccagaaaagtcagaacaatttgaggagcttcaaagcatccttaagaaagggaaactaacttttgagaatattatggaaaaactgcgaatcaagtattccgaaatgtacaccatagtccctgcagagattgaatcccaggtggaagaatgcagaaaagctttagaagacatagatgagaagattagcaatgaagtcttaaaaagctcaccatcatatgcaatgaggagaaaaatagaagaaattaacaatgggcttcataatgttgaaaagatgttgcagcagaaaagcaaaaatattgagaaagctcaagaaattcaaaagaaaatgtgggacgagttagatctatggcattccaaactaaatgagctggattctgaagttcaggacattgttgaacaggacccaggacaggctcaagaatggatggataacttgatgattcctttccagcagtatcagcaagtatcacagagagcagagtgtagaacctcacagttgaataaggccacagttaagatggaggaatatagtgaccttctgaagagcactgaggcttggatagaaaataccagtcatttgctggccaatcctgctgactatgactctttgaggacactgagtcaccatgctagcactgtgcagatggctttggaagattcagaacagaagcacaatcttttacattcaatctttatggatctagaagacctgtcaataatttttgaaacagatgaattaacccaatccatacaagagttaagtaatcaagtaacagctttacaacaaaaaataatggaaagccttccacagattcagcgaatggctgatgatgtggttgctattgaatctgaagtaaaatcaatggaaaaaagagtttcaaaaatcaaaactatcctattatcaaaagaaatatttgatttttcacctgaagaacatctcaaacatggggaggtcatacttgaaaatatacgtcccatgaagaaaaccattgctgagatagtgtcttaccaagtggaactgaggttgccccaaacaggaatgaaacctctgcctgtgtttcagcggacaaatcagcttttacaagatataaaactattggaaaatgtgactcaagaacaaaatgagttattaaaggtagtcataaaacagaccaatgaatgggatgaagaaatagaaaatttgaaacagatcttaaataattattcagctcagttctcccttgaacatatgtcaccagaccaagctgacaagctgccacaactacagggagaaatcgaacgtatggagaaacagattctgagtttgaaccagagaaaagaagacctgttggtggacttgaaggccaccgtactaaaccttcaccagcatttgaagcaagaacaagaaggagtagaaagagataggctgccagctgtaacatcagaggaaggtggagtggcagagagggatgcttctgagcggaagttgaacagaagaggctccatgtcttacctggcagcagtcgaggaagaggtggaagaaagttccgtgaagagcgatcatgacaaggacatggaagaagacagagcttcctcatcctctggaacaattgttcaggaagcatatgggaaaataagcacctctgataattccatggcacaaatcctcacaccagactcactaaacactgagcaaggcccagaatgttccctaaggcccaaccaaacagaagagggcaccacacctcctattgaggctgacactctggactcttctgacgcgcaaggaggtttggagcccagggtggagaaaactaggccggagcccacagaagtcctgcatgcctgcaagacccaggtggccgagctggagctgtggctgcaacaagccaacgtggcagttgagccggaaacattaaacgcagacatgcagcaggtgctggaacagcagctggtagggtgccaggctatgctaacagagattgagcacaaggttgcctttctgttagagacttgcaaagatcagggcctgggagataatggagccactcaacatgaggctgaagcgctttccctgaaactgaaaacagtgaagtgcaatttagaaaaagtccagatgatgcttcaggagaagcacagtgaagatcagcatcctaccattctaaagaaatcctcagagccagagcatcaagaagctctccaaccagttaacctttctgaattggaatccattgtaactgaaaggccacaattcagcagacaaaaagatttccagcagcaacaggttctggagttaaaaccaatggaacagaaagatttcatcaaattcatagaatttaatgctaagaaaatgtggccccagtattgccaacatgataacgatacaactcaggaatcatctgcaagatacccaacaactgaagaactgaaaacctataccacccaacttgaagacctgcgccaagaagcaagtaaccttcagacacaggaaaatatgacagaagaagcatatatcaatttggataaaaaattgtttgaactattcctgaccctcagtcagtgcctcagcagtgtggaggagatgctggagatgcccagactttacagggaggatggttctggccagcaggtgcactacgagacgctggctcttgagttgaagaaactttatttagcgctaagtgacaagaagggtgatcttttgaaagccatgacttggcctggcgagaacaccaacttgctccttgaatgttttgacaaccttcaagtctgcctggagcacactcaggctgcagctgtctgtagaagcaagtccctgaaagctggcctcgattacaaccgcagttaccagaaagcagatgcatatacagtggagctggagaacgccgagagccgagtggccaaactaagagatgaaggggagaggcttcatttaccttatgctttactccaggaggtttacaaattagaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggctttaccaaactctgaacgaaggcaaacagttggtggcgtctgtgagctgtcctgaattagagggccagatcgcaaaactggaagagcagtggttgtccctgaacaagaaaattgaccatgagctccacaggctgcaagctcttctcaagcatctgctcagttataacagagattcggatcagttaaccaagtggttggaatcttcccagcatactctgaattactggaaagaacagtccctcaatgtgtctcaggacttggatacaatcagaagcaacatcaacaatttttttgagttttcaaaagaagttgatgaaaaatcctccttgaagactgccgttatcagtatcgggaaccagcttcttcacctgaaagaaactgatacagctacactgagagcttctttagcacagtttgaacaaaaatggacaatgctcataactcaacttccagatattcaagaaaaacttcaccagcttcaaatggagaaattgccgtctcgtaaagcaatcacagaaatgattagctggatgaacaatgtggagcatcaaacttcagatgaagactccgtgcattcaccaagttctgcatctcaagttaaacatcttcttcagaagcacaaggagtttagaatggaaatggactataaacagtggatagttgacttcgttaaccagtcattacttcagctaagcacctgtgatgtagaaagcaagcgctatgaaagaacggagtttgcagagcacctgggggagatgaaccgccagtggcaccgtgtacatggaatgctgaatagaaagatacaacatttagaacaacttctagaaagtatcactgagagtgaaaataaaatacagatcttgaacaactggctggaagcacaagaagagagactgaaaactttacaaaaacctgaaagtgtgatctcagtgcagaagctgctcctggactgtcaggatatagaaaatcaacttgcaattaaatccaaagcactagatgagttgaaacaaagttatctgactttggagagtggggcagtgccattgttagaagatacagcatcccgaattgatgagttatttcaaaagagaagcagtgttctcactcaggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagaatcatgtgctggcactgacagcccaatcacctgatattgaacatttgaatgaagtgagcctcaagctcccacttagtgacgtagctgtgaagacgttacaaaatatgaaccggcaatggattcgggccacggccacggcactggagcgctgcagtgagcttcagggaattggattgaatgaaaagtttctttattgctgtgaaaagtggatccaacttttggagaagatagaagaagcactcaaagtggatgtggctaacagccttcctgagctcctggagcagcagaaaacctataagatgttagaagctgaagtttctataaaccagacaattgctgattcctatgtcacccagtccttacaactcctggacacaacagaaatagagaacagaccagaatttattacagaattctcaaagctgacggatcggtggcagaatgctgtccagggtgttcggcagaggaagggtgacgttgatgggctgaacgcccatgtagccaggtgtggtggcgcatctcttaaaaaacaggaccttcgctactctctgcacactgcctgcggagcggccctgctctgcaggagcagtcacggagctaataaagaaattcattttcaaaggaggcgaactacctgtgccctaaccttggaagctggagaaaagttactgctcacaactgacctgaaaactaaagagtctgtgggtaggagaatcagtcaacttcaggacagctggaaagacatggagccccagctggcagagatgattaagcagttccagagcactgtagagacctgggaccagtgtgaaaagaaaatcaaggagttgaaaagcaggctgcaagttttaaaggcacaaagtgaagatcctcttccagagcttcacgaggacctccataacgaaaaagagctgattaaggtggccatacgtaaacaggagattgaagacagactcaatacatgggttgtattcaatgaaaaaaataaagagttgtgtgcctggctggtgcagatggaaaacaaagttctacagacagcggacattagtattgaagaaatgattgaaaagttacagaagagaacagttggaagagaggaggttccagagagatgggagtgtgagaccattgtcagtgggcatggtaccgaggagagttgctttctctccattagaaagtttcaccagggaaggggcttacatatccttacatgtcagctgataccccaagactgcatggaagaaataaacttgtttagtgaaaacaagttacagttaaagcagatgggtgaccagttgatcaaggccagcaacaaatcaagagcagctgagatcgatgacaagctcaacaaaattaacgatcgttggcaacatctttttgatgtcatcggatcaagtatggcagatcagacaaactccaggtggatgttttttcagtggccacgtggcatacagcgaaccgtcacttggccttgggaccacttgtgcagctgtgcttccactggccacacgggtcctttccatagcagtgtgctcagatgttttgaacaacacatagaatttggaatatacaggagaacctataaggtgaataaagaattgggaggtgataaaaacggacagagatgccccataatctacccgcatgggctggttcaatgtatacggctgggtgaacccctcatactgaagcgggtgaagaagctgaaggagacctttgcttttattcagcagttggacaaaaacatgagcaaccttcgcacctggttggctcgaattgagtctgagctttccaagcctgttgtttatgatgtctgcgatgatcaagagatccagaagaggctcgctgagcagcaggatctacagcgagatattgaacaacacagcgcaggggtggagtccgtgtttaacatctgtgacgtcctactgcacgactccgatgcctgtgcaaatgagaccgagtgtgactcgatccagcagaccaccaggagcctggacagacgctggaggaacatttgtgccatgtccatggagcggcgcatgaaaatcgaggagacgtggcgcctgtggcagaagtttttagacgactattctcgctttgaggactggctcaagtcagctgagaggacggcagcctgcccaaattcctcagaggtgttgtacacgagtgccaaagaggaactgaagaggtttgagcggcagattcatgagcggctcactcagctggagctcatcaacaagcagtaccggcggctggcccgggagaaccgcacagacacggccagcaggctgaagcagatggtccacgagggcaaccagcgctgggacaaccttcagaggcgggtcacagccgtcctgcggagactcaggcatttcaccaaccagagggaagaatttgagggcaccagggagagcattctggtgtggctcacagagatggacctgcagctgaccaacgtggagcacttctcagagagtgacgccgatgacaagatgcgccaactgaatggcttccaacaggaaattacattaaataccaacaagattgatcagctcattgtgtttggggagcagctgattcagaagagcgagcccctggatgctgtgctgattgaggatgagctggaggaactccaccgctactgccaggagggcttggaagatgaaaaggaggcctctgagaatgaaacagacatggaagaccccagagaaatccagactgattcttggcgtaaacggggagagagcgaggaaccgtcatctcctcagtccctgtgtcatctagtggccccagggcacgagcggtctggctgcgagacccctgtcagcgtggactccatccccctggagtgggaccacacaggcgacgtggggggctcctcctctcacgaagaggacgaggagggcccatactacagcgcactgtcaggtaaatccatttcggatggccactcgtggcatgttcccgacagcccttcctgtcccgagcatcactacaagcaaatggaaggtgacaggaatgttccacctgttccccctgcgtccagcaccccttataaaccaccctatgtaagtcttaacttcactgggagtacagcctatgtctgtgccttcgacagatgggagatgattcaagcacaggagcttcacaataagctcaaaataaaacaaaatttgcaacagctgaactctgatatcagcgccatcactacttggctgaaaaaaactgaagcagagctggaaatgttaaagatggcaaagcctccctctgatatccaggaaatagaactgagagtgaagagactgcaggagatactgaaagcctttgacacttacaaggcattagtggtctctgtcaacgtgagcagcaaggaatttctgcaaaccgagagccccgaatccacagagctccaaagtagactccgccagctgagcctgctctgggaagcagcacagggcgcagtggacagctggagagggggcttacgacagtcgctcatgcagtgccaggacttccaccagttgagtcaaaatctgctgctgtggttagcgagtgccaagaaccggaggcagaaggctcatgtcaccgatccaaaggcagacccccgggctctcctagagtgtcggagggaactaatgcaactggaaaaggagctggtagaacgtcaacctcaagtggacatgttacaggagatttcaaacagccttctcattaagggacatggagaagactgtattgaagctgaagaaaaggtgcatgttattgagaagaaactcaaacagttacgggagcaagtgtcccaagatttaatggccttgcagggaacccagaacccagcctcacccctgcccagcttcgacgaggtagactcgggggaccagcctcctgcaacatccgtgccagctccccgagcaaagtttctttacccagcagttcagagcagtgagaactacagaaggcgaggaggagacagagagcagggtccccggcagcacacggccacagcgctccttcctctcaagggtggtccgggcagccctacccctgcagctgctcctcctgctgctgctgctcctggcctgcctgctgccctcctccgaagaagactacagctgcactcaggccaacaactttgcccggtccttttaccccatgctgaggtacaccaatgggccaccccccacatagagggcatagctggccacagtgctacaccacctgcctga

SEQ ID NO: 185341 - DNA, 3275 bp, Homo sapiens
  Payload ID: 16496
  Gene Symbol: SYNE3
  Gene Name: spectrin repeat containing, nuclear envelope family member 3
  Uniprot ID: Q6ZMZ3
  ENST ID: ENST00000334258
  CDS Start-End: 16-2943
gcccctgcaggtgccatgactcagcagccccaggacgactttgacaggagcgtggaggatgcccaggcatggatgaaggctgtgcaggaccagctgcaggtcaatgacaacacgcagggaccccgcgcggccctggaggccaggctgtgggagaccgagaaaatatgccagctggagcccgaggggcgtgtgagggtggacctcgtgctacggatggctgaagccctcttggcatgctgccctggggaccagaagcccgggatcctggcccggctgaaggacatcaaggcccaatgggaggagacagtcacctacatgactcactgtcacagccgcatcgagtgggtgtggctgcactggagcgagtacctgctggcccgagatgagttctaccgctggttccagaagatgatggtcacactggagccccacatcgagctccagctgggcctgaaggagaagcagtggcagctgagccacgcccaggtgctgctgcacaacgtggacaaccaggcggtgctcctggaccggctgctggaggaggcagcctccctgttcaacaggatcggggaccccagcgtggacgaagatgcccagaagagaatgaaggctgagtacgatgcagtgaaggccaaggcccagaagcgtgtagatctgctggagcaggtggcccgggagcatgaggagtaccaggcaggtgtggacgagttccaactgtggctgaaggcggtggtggagaaggtgaatggctgcctggggcggaactgcaagctgcccatcacgcagcgcctctccacactgcaggacattgccaaagattttcccaggggcgaggagtctctggagacgctggaggagcagtctgcgggtgtcattcggaacacctctcctttgggtgcagagaagatcaccggagaactggaagagatgaggaaagttctggagaagctgcgcgccctctgggaggaggaggaggagcggctgcggggcctgctccggtccaggggagcctgggagcagcagattaagcagctggaggctgagctcagtgagttcaggatggtcctgcagaggctggcccaggagggcctgcagcctgcggcgaaagcggggaccgaggacgagctggtggcacactggagacgctactcggcaacacgggcggcgctggcctcggaggagccccgggtggaccggctgcaagcccagctgaaggagctcatcgtcttccctcacaacctgaagccactctctgatagtgtcatcgctaccatccaggagtatcagagcctgaaggtgaagagcgcgaggctgcgcaatgccgcggcggtggagctgtggcagcatttccagcggcctctgcaggatctgcagctgtggaaggccctggcccagcggctcttggaggtcactgccagcctgccggacctgccttcccttcacaccttcctgccccagatcgaggcagccctgatggaaagctcccgcctgaaagagctgctgacgatgctgcagctgaagaaagacctcctgattggcatctttggccaggagagagccacggcactcctggagcaggtggcaggttccatgagggacagagacctgctgcataacagcctcctgcagaggaaaagcaaactgcagagcctgctcgctcagcacaaagactttggagcagcttttgagcccctgcagaggaagctcttggacctccaggtcagggtccaagccgagaaggggcttcagcgggaccttcctggaaaacaggcccagctctcaaggttgcaggggctgcaggaagaggggctggacttgggggcacagatggaggctgcaaggcctctggtccaggagaaccccaaccaccagcacaaaatggaccagctttcctccgacttccaggccctgcagaggtctctggaggaccttgtggacaggtgtcggcagagtgtgcaggagcactgcaccttcagccaccagctgctggagctgcggcagtggatcgttgtgaccacgcaaaagctggaggcacaccggggagaggcgggcccgggggatgccgagtcccaagaggccgagtttgagaggctggtggcagaattcccggagaaggaggcccagctgtccctggtggaagcgcagggctggctggtgatggagaagtcttctccggagggtgctgccgtggtgcaggaggagctcagggagctggcagagtcgtggcgggccttgaggctgctggaagaaagtctgctgagcctcatcagaaactggcatctgcagaggatggaagtggattcggggaagaaaatggttttcaccaacaacatcccaaagtcaggatttctcatcaatcccatggatcctattcccaggcatcgtcgacgcgcaaatcttctacaggaagaagaagggagccatgaagatttctcccagctcctgaggaactttgggcagtggttgcaggtggaaaactccaagctggttagaatcatcgcaatgagaacttctacagctgaggacttgaggaccagaaaatcgaagctgcaggagctggaggctcgggtgccagaaggtcagcatctctttgagaacctccttcgtctcgggccagcaagggggacctcggatgagctggaagatctgcgctaccagtggatgctgtacaagtccaagctgaaggactctggccacctgctgacacaaagttctccaggggagccgactggattccaaaagactcggcggtggcgaggactgggctccctcttccggagggcgtgctgtgtggcgctcccactgcagctgcttctgctgctgttcctcctcctgctgttcctgctcccaatcagggaagaggaccgcagctgcaccctggccaacaacttcgcccgctccttcacgctcatgctgcgctacaatggcccaccacccacctaacccactggggcacacaggtgactttctcctccaacctccatcagtcccagggcccctcctgaggatgctcgccagggaaactggaaacaggggcagggcaaagactgcagagctgcatccatatcagtgctgtgtcagcgttcccagaagacacttactttttatacagtgttgtcttagtctatttatactaaatgtgtactacatgtgactagggaataatgtctagaatttttatatgatctgtatgtaaatgctcagtatgtataatttcatatacgagttctatttggagttgggaaaattcctagcaatggctccctccaatggga

SEQ ID NO: 185342 - DNA, 13488 bp, Homo sapiens
  Payload ID: 16496
  Gene Symbol: SYNE3
  Gene Name: spectrin repeat containing, nuclear envelope family member 3
  Uniprot ID: Q6ZMZ3
  ENST ID: ENST00000557275
  CDS Start-End: 16-2928
gcccctgcaggtgccatgactcagcagccccaggacgactttgacaggagcgtggaggatgcccaggcatggatgaaggctgtgcaggaccagctgcaggtcaatgacaacacgcagggaccccgcgcggccctggaggccaggctgtgggagaccgagaaaatatgccagctggagcccgaggggcgtgtgagggtggacctcgtgctacggatggctgaagccctcttggcatgctgccctggggaccagaagcccgggatcctggcccggctgaaggacatcaaggcccaatgggaggagacagtcacctacatgactcactgtcacagccgcatcgagtgggtgtggctgcactggagcgagtacctgctggcccgagatgagttctaccgctggttccagaagatgatggtcacactggagccccacatcgagctccagctgggcctgaaggagaagcagtggcagctgagccacgcccaggtgctgctgcacaacgtggacaaccaggcggtgctcctggaccggctgctggaggaggcagcctccctgttcaacaggatcggggaccccagcgtggacgaagatgcccagaagagaatgaaggctgagtacgatgcagtgaaggccaaggcccagaagcgtgtagatctgctggagcaggtggcccgggagcatgaggagtaccaggcaggtgtggacgagttccaactgtggctgaaggcggtggtggagaaggtgaatggctgcctggggcggaactgcaagctgcccatcacgcagcgcctctccacactgcaggacattgccaaagattttcccaggggcgaggagtctctggagacgctggaggagcagtctgcgggtgtcattcggaacacctctcctttgggtgcagagaagatcaccggagaactggaagagatgaggaaagttctggagaagctgcgcgccctctgggaggaggaggaggagcggctgcggggcctgctccggtccaggggagcctgggagcagcagattaagcagctggaggctgagctcagtgagttcaggatggtcctgcagaggctggcccaggagggcctgcagcctgcggcgaaagcggggaccgaggacgagctggtggcacactggagacgctactcggcaacacgggcggcgctggcctcggaggagccccgggtggaccggctgcaagcccagctgaaggagctcatcgtcttccctcacaacctgaagccactctctgatagtgtcatcgctaccatccaggagtatcagagcctgaaggtgaagagcgcgaggctgcgcaatgccgcggcggtggagctgtggcagcatttccagcggcctctgcaggatctgcagctgtggaaggccctggcccagcggctcttggaggtcactgccagcctgccggacctgccttcccttcacaccttcctgccccagatcgaggcagccctgatggaaagctcccgcctgaaagagctgctgacgatgctgcagctgaagaaagacctcctgattggcatctttggccaggagagagccacggcactcctggagcaggtggcaggttccatgagggacagagacctgctgcataacagcctcctgcagaggaaaagcaaactgcagagcctgctcgctcagcacaaagactttggagcagcttttgagcccctgcagaggaagctcttggacctccaggtcagggtccaagccgagaaggggcttcagcgggaccttcctggaaaacaggcccagctctcaaggttgcaggggctgcaggaagaggggctggacttgggggcacagatggaggctgcaaggcctctggtccaggagaaccccaaccaccagcacaaaatggaccagctttcctccgacttccaggccctgcagaggtctctggaggaccttgtggacaggtgtcggcagagtgtgcaggagcactgcaccttcagccaccagctgctggagctgcggcagtggatcgttgtgaccacgcaaaagctggaggcacaccggggagaggcgggcccgggggatgccgagtcccaagaggccgagtttgagaggctggtggcagaattcccggagaaggaggcccagctgtccctggtggaagcgcagggctggctggtgatggagaagtcttctccggagggtgctgccgtggtgcaggaggagctcagggagctggcagagtcgtggcgggccttgaggctgctggaagaaagtctgctgagcctcatcagaaactggcatctgcagaggatggaagtggattcggggaagaaaatggttttcaccaacaacatcccaaagtcaggatttctcatcaatcccatggatcctattcccaggcatcgtcgacgcgaagaagaagggagccatgaagatttctcccagctcctgaggaactttgggcagtggttgcaggtggaaaactccaagctggttagaatcatcgcaatgagaacttctacagctgaggacttgaggaccagaaaatcgaagctgcaggagctggaggctcgggtgccagaaggtcagcatctctttgagaacctccttcgtctcgggccagcaagggggacctcggatgagctggaagatctgcgctaccagtggatgctgtacaagtccaagctgaaggactctggccacctgctgacacaaagttctccaggggagccgactggattccaaaagactcggcggtggcgaggactgggctccctcttccggagggcgtgctgtgtggcgctcccactgcagctgcttctgctgctgttcctcctcctgctgttcctgctcccaatcagggaagaggaccgcagctgcaccctggccaacaacttcgcccgctccttcacgctcatgctgcgctacaatggcccaccacccacctaacccactggggcacacaggtgactttctcctccaacctccatcagtcccagggcccctcctgaggatgctcgccagggaaactggaaacaggggcagggcaaagactgcagagctgcatccatatcagtgctgtgtcagcgttcccagaagacacttactttttatacagtgttgtcttagtctatttatactaaatgtgtactacatgtgactagggaataatgtctagaatttttatatgatctgtatgtaaatgctcagtatgtataatttcatatacgagttctatttggagttgggaaaattcctagcaatggctccctccaatgggattttgtggtattgttgacttggtctgcagtcaaccctagaaagcaagaacaataacatgtcactttcatggcaacctcttctccaaagcgaatcccagaattcagatgtaatgaaaggcctctgagctgcaacgtggaagagcgccatagaccctcacttggtgcccagcgactcttgctttatgcgtaatgagaacaagtatgcttgtctagttttaacaaccacaaagagtagctgccacgtgtcagaagtagaaatggcaatgaccagaggcaggttcaatgatagcagtgacaagtgacagagtgatatcgagggagaaaaagaagagctgcagagagcagatccccgaactaagaaagcacagctgtgtggaggcattgcatgccggagccctaaccccagctctcagcggcttctgatcacacagacctatgaggactgtccctggtgatgacaccgagcccccatgaaacggtgagatcctgctctgtgtgtttcattcagggagaaagggaagaagacaagcttgatttttaagatttccatgcagaatggtgaggcacactcggtgggcagcacccactggcagtgcccaggaaagatgtgtttcctctgttgctcctggactgagttttcatcgtcgagagctcgagctgcaggtgagaagggaagcatctgccacgccaggggccagggatcgagggtccaggacagaggtgagagaatctgctttggagttcagcctgtctcaagggctctccttccgcttcccagaaaagactctggagacagcaggtctatggggccaagaaggtctcatgtgcatccccatatgggactagggcccaggccacccaaaaccaggccctctccagccaggtgtaggcgagctgggctccatgcaccacctgggctggggccgcggtgactccatgtgagttcccgaggccagaaactcatcccttccttgccagggaactctgggatggttcctaagtgctctacaactggatcatgtttttcctaaatcaacactaaattttcccctttaaaaaagtacttaatgcccactctctacaaatggattttgtctgttcaactacaaatacgaggggatttcctcggaccttctgtccggctttggaatcataaggtattatagacccagaaaggccctttaagtagaggggaaactgaggacctaagagggcctgatacccagcaccattgctgtctcacacacactgaccctttgcctttcactgtgagctctgcccttggggacccgggtcctaggcaactaggacatttcaccggcaggaaacccgtgctgccaaggagagcccttggggctgactcagaaagcgtacttttttttttcttttaactcgtctgtatttgttacaactttaagcagaatgtgacttgggcactatatttccatccacaagcctggctctgagttattattattattgttattataattattttgagatggagtttcgctctttttgcccaggctggagtgcagtggtgcgatctcggctcactgcaacctccgcctcccagattcaagcgattctcctgcttcagcctcccaaatagctgggattacaggcatctgccaccatgcccagctaatttttgtatttttagtagagttagggttttaccatgttggccaggctggtctcgaactcctgacctcaggtgatccgcccacctcagcgtcccaaagcactgggattacaggcatgagccaccatgcctggccatttttttttttttttgaatagctttatgataagctgtaggcttataattatgctcctccaaacaacacttttctttggaaaacaagccctgtagactctccatccttccatcaagttccttccctcaagctgcttcagtttaacttatttctacaagactagtacatgcagaattggcaactacaggggatgaaaagttcaaaaagtagatcctacaaccctgtgacttggtttccaaatatctagagaaatttgtgatttcatggaagaagagaaagcacacttttctccagatatctggaaaccaagccatagggccgttctctgcaggcgaccaccttactggaaaatcaggagctgagtgagcccaggcagccaagcccagatgtccagtcctggaagtcagagcagtggcagggtgggtgggtgggggggccttgccaggtgtccactttcctatgtcacaggtgagaaagctgaggcccagaatggggaagaaactgatccatggccacacagtgagaggcagcaaggccagagcccaactggccaccatggccctcaggtggtaccctgctcattgtggtatgatccgctcatgtcagcaactacatgaaaaaaacagccactgggcatgtatgcagcctgtcacatataccacatgttggggaaggagaagctggaacatgcgggcgggggtgggaatatctacctatattttttaaattttgataatgatgccatcaagtctgtttgtttgcataactgttttttaaaaaagaattgatattttcagtattttcatataaatatacttgtaatataacgtaacagcccagttactggtgcttccaagcacaagtgcaatctcctttgcttaaaggagagccaggcaattattcttatgactttagtttccagcctctttaacagccatgcagagctttaaggtgctacttgagaaaggtggcgctgtggcgtgtgtgtgtgtgtgtgtgtgtgtgtgtgtgtgtgtgtgtgtgtgtcagagagagagagaggagggaaggagaggagggagaaaggaccaccagtgggtcggttgatgaattagttatccctgcttacctgtccctcccacccctttctttcttagcccgttctctgcatgtggaaaggcacatgcagcacccagagggtgtttaaaaagaaaagctgggagcgggagggatgggcaggtactgacagcagacgaggcgaggagaccctgggaggtgcccagtggtggcgggacagagggaacaccgacaagggagacaaagaatgtgctcgtttggtgctcgtgggtgcttgagccccttgggcggcactttgcagccttgctttatgtaattcccacatcgacacctgcccccagggtttgatactgttttacccccatgtttgagatggaaccctgaggcttaaagatataaagacccttgctcatgctgaagtgggtccaaacccacaacatggggcaatgaggaccccaaagcccaggctggaggggggcttcaggctggttctaccaggttgcagtctctgtagcctctgggaatggagttccctgggcaagcaggcagaactctctgcccatcagctcgcctgggacatggccagagcggagcatccaaatgtttccctgagggactgccctcagctctgagatgagtcaccaccagcagcacattcccttgggccatctatcattatcttcacattgctcacctggaagatgagcccctctaatgtctcatgatgaggtcctcggtcatgaatgacagaactccacacccccaatgcccagcacaggataagagcttcagctgtggtttgttgaattacattaaaaacccaaaggcaaatgtgtttcctgacacccgactcccttccagaggaaatgggtcaaggatgacctgacccaattccatctctcaggccccgtttgcttcaggcagctggctggagttccctgcagggaccgggggtccaaagatgcttgtctccgggcatcttcaggggaaggaagctggggaccctctgcaccctgggggccaaggagaatgacaggcagagggcaggaaaaggcctgaaggcgggtggtttgtgctggatgttccctaatggattttacagctggcaaactgggaccggtggcatcatcctgccctgccttgcaggggatgggaggctggggctgcccacagttagggagtaaagaggggatcttatctcttccattagactggagccaggcctgactgggaagctgggaggctttgcagaagctttgaggaactgcactttatggtggtctggctggagagggcggacggggaagtgggccagagggagtcaaaggccagaggtgatgtcaggcttgatttactgaactgtgtgcttaaaagtggttaagatgctaaattttatgttatgtttattttaccacaatttgagggtgagaggagagagtgagagcaaaagagacagagagaagagagagaaaaggaggaagggagggagggagggagggatagagagagagaaaaagagaatgggaatggcaggctgtgccttcatggttcccaactttcctctgaggacaagcgctagtggcaaagctttcactgaccaaaggcaagtgaaacaatacgagggaacaacttgagtttttctttccataggatttattttgcccaaacgctggctcttcattctgggattatgtccctcctacttcaagggtgctcaatggcctttaggaaatgagggataggtaaaggtggctctgtcttctttgatggtttctattgtgttttgggagccctcattggacaaaataaaaagttgccaactctatgttggttttgctccccatacagtattcttcctggaaaaacatgctgtctgaaagtttgggaacccaggagatggttgggagaagagagcagcttgaggattgcttagtgcaggagtccccgagggagagaaggaaagagaaatgggaagagggacatcgtggaaagttgtggcaactgggttcaggggaggccaggagcctgccagctgtggcctctaaaaaaataaaacccaggtgctcactggccctgccttcccactggccattcggatgctgtccggggtctgcggctttctctcccctggttggtgggcagaagtgccctgtgcctctttgcatcttaatccaatgcaacaagcattctccagcctgtgccaggctttgtgctgggagattcggggtgaacaaagcccagtccctgccctcagggagcttgcagacgaagaaaagggtttgtgccattgaagatgcccaacgggattgcagtcattgcccttgactttgcccatctgcctttccagagggggcaggcccactgtcacagaaactggaagagccacacaggggagacagtgggagagctcggaacagggcatgagagtgtcttgctgcctcttggaggccaccattgtgactatgaaccataccgggcagaggaagtgggtcaaggaggccagggcagctgggccgggcagggagaggacctgggcatggcagaggaggggaaaatagactgacccagcctcaggaggtcagaagtgtgttgggctgtgctgggtcacagaacaacacagcttgggaggctcctggaggcttcaaggggaggcttaaggctaaggctgtggatgttgattgtcgtgtccattactagcccaattattagtctgtcttcctggtaaaaatgtgtggttggaaatgccaaactgagaagcccacttttccccactggggatcatctgggttggcgtgtccatgctcaaggataatctcttgccctttcctgccccctgcctaggatttctccccagaggagaggagctgagggacccccccagggaggctgtgcctgtggctgtcaccctatgatgccagcggcttcctttggattctgtaatcagagtgtttttcaccggtgtctgcagtgattgccaggaagcctctgtgtccatagcccagcgggatcctgccctaattccctctctcatgggcactcagctaattctcaccccaatctcattgtcaccagtctaggtcagcattggagggaggtgtgggcaactacagcccttgctgcttccaagacagacatcaaaatagttgatcaccaacctttcccactccccactctctgacccaatggacctcacagtcctcaaaactactccaagctactgccaatcaatcattttcttatgtgagcaaaacctgtttgacatccttacacctgtaccagccctctcagaaagctctcaattctggtctccttttcttttttctttttttttttttgaatttatgttaaaattaggatgttcccaatcaaaaaatcatttttccttcatctagtaattgggtgagacaaactagccccagaaagcagacaatgggatgaactgccaagtaggacttttaggggaggcaaaatggattaggaaatgctaagttctctgttgaaggaggatacctggattcttcaggctgtcagagttggagggcttccatagactgtcttgttccaactttgtacccattttacaggttaggactctgagacctcagcagttcttgtttggccagtgagctcagggagttagttccaggagtgggggtcggtctctgcacccactggatgacagcttgatactgctcagcactagacagggttgagttggaactctgctgctgatgggctgtgtgacattggtccagttccttaccacctccccccacctattggtaaggagggaagtcagccctggagcgttcagtgctccctgaaatattaggtatcctaggattgtgcgcgtgggctcgcatctggaagagaaatccctagattcagccacgagtaacagaatccctcctcccccgaccaactttggcttaaaccagtcagagactttacttttctctcctcctgagaagtctagatataggcggttgctggcatcgtctcctcaggttatggatgtcagagccaaggctttgcaactgtccttcctttatatcacagtcacttcatggcccaggatgcttgctgtacctccaatttttcatctgggttccaggtaggaagaaggggagtgaactagacgaatctgccctcctcattagcagctttcccagaagctccaccagccacttccgttctcatctcattggccaggactgtgtcacatgttttcccccacatctgcaaggagtctgggaacatgtgccccaaaaagatgggggctcttctagtaagaatgaagggtagggtggcttggagtggcacttcgctgtctctgctacaattggaggagaaaaccagagtttgtcctgaccctccatgccttggctgtatgctccttgtgtggaactcgaaggcatcatccttgcagtgtgagagtgacctgccaccacggcctgccacctcctctcaggggaccctgagtccttcaggtctacccaaaggcattgtagacattcttcctgcaaggcttgggaaccgacaaatagatctgcccagcttgccagagtttttgtgcaggaacagcccctcccgtctttgtcctggcggtgagcacccagggctaagcttttgaacactttctttgtgtttggattcagcccaggcaatgcatatttgctttcatttcttcttgagcttgaggagctcctgggtgcaaatcttggaaaatgaggatctctgagcctttccaggccagctctttgttttgtagcagacaattgaggctttgaaaaggaaagtgggtgggggcaccccacaggtggccctcatcacccaattgccagtgcctgcaggctgcttcagcagaggcccagagtcaaagaggacttaaaaccagctgtcgtttctcccttagcttctgtgtatgagagaaacgacttctgtttttcaaagtaagaacaaggaggaatttgtttctaaaagaacattaaaacacaggctcgtggtctaaaagcaaatggttcagcaggatgttcagggccttaaagcacagtcagcaggactcagcatctcccagcacctgctctccggttgtcatggtaacatcatccccaacccaaccaccttgtccagccgagagacagcaatcataaggagggacctcggtttcccccgaggatcctgggcttcctttctgaaacgcttgcttctgagctcagcaaccaggaacaccaggccagcccatccccagcacctctgtggagatgagggacaaagtcctacagtccctcttcctgttctgatgagaaagggagggaagaaaacataccccgagcgcctgcaatatggtcatgacactttcaaaaagcctgtgctatggagtcatgatcagaaaccagagtgtggagagggtcagcagcctgcctcagagcagccagctaggcggggagtggtaaatttgggacttgtacccaggcatgactggctccgagcccagtgctccactctatggaatgttccctgggcctcagttgctttcctttcctttgcaggccgcgggctgctgccactctggcagctggtgagttagctggagggcaacattccaaagcaggggcagcatgctgctttcctcctgtgcccactcctgcggggaagtccgttgactcccaccgctgaagggagctggcaacaccaggatgaggtcccaggggacgggagcaggtacccactgtctgtctaccttcccactggaaaagcacggacaggccagcccttgcgggggcaggcagaggacagagttggctttgcgcggtctctgcctgctgagcagttccaattcctctcatgggagaaacaaggaggcagtcgcttgtgcatgttccagaagttttactggggaggaggaagcggacagaggaagctgtgtgtgcatgtgaaggggtgggcagggtgggagggatgcacgcgtatgtgagcatagcatgtgtgagtactacacacatctccatgcagaagcacaactgggcagccctggcttccagctctgggcttcagcacaacagacaccagcctgtggtctctcagaagccagggagaccacatcgggctcaggacgttttacccaaagtccagagtttttatgcctctccctggcattctccataaagaagggaaggtcagatgaccccttagatctgtgtcatctgggaatttccttgggctggtttagacacgatgccctctttttctcaggatagcagataacctgctttgaaagagggcttaattctgtgggtcctaaattttctcctttctctctctctttctgtgtgtgtgtgttgggaaaatggcaagtttccaataccagctttggaggaacgattacgttttccctccaatttcaagtccgaaagaccagagccctcattccaaagccccccacccagatggattttttcgtttcatttgtcatccgtcccatgggagggccccatgtctcctcagaacccatcctggaggcagcaggtcgggtagagtgagtttggcctgctcatgacctccacccctgagattgtgaacaaggatgtctggggcgatgctgagaatgtttttgaagctgctcccagatgacgctgatgatcacaccagattgagtgctgcgatcgccttgagtccaacctctgcataaacgaggttctcataaacaagttcactctaccctaagctaagtctatgtgagcaaacccacttcatcctttgtacctggagacctggttacactaacctgatactgacctgttcatgtagctggaatggtgtgtttcatgcagtgtggaccaagcaatggcatggggtgtgtgtgtgtgtgtgtgtgtgtctgtgtgtgtgtgtttgtgtatgcgttcacacttgtgtgtgtatatgtgcatgtagatgctgcataaatgatttttgatgtcaaagacaaacacattccattgttttaaatattctattatgtaaacaatacgcagagggaccatatctactcttgtcatattatttgtgatggtaaaacatgcatttgcaataaattaagctttctgggaaggcaagcagtattggagccaaacgactgtctcggaacatgtgtgtgttatctcggttcatatcaagtccaaagctaatggagccttccccgccatccagggaggaacaccaggaccccggagtttcttcttagtgctatattttaaagttgcattgacgttttcctccccttccttttgtgcaagttggaagtagcagtgttctaaaagatggtttgacgtttttgctgttgttttatgtttttaaaaatgtatctgctttgtgtttggaaataaaaatctctattttggtctatgaaa

SEQ ID NO: 185343 - DNA, 2615 bp, Homo sapiens
  Payload ID: 16496
  Gene Symbol: SYNE3
  Gene Name: spectrin repeat containing, nuclear envelope family member 3
  Uniprot ID: Q6ZMZ3
  ENST ID: ENST00000553340
  CDS Start-End: 16-1806
gcccctgcaggtgccatgactcagcagccccaggacgactttgacaggagcgtggaggatgcccaggcatggatgaaggctgtgcaggaccagctgcaggtcaatgacaacacgcagggaccccgcgcggccctggaggccaggctgtgggagaccgagaaaatatgccagctggagcccgaggggcgtgtgagggtggacctcgtgctacggatggctgaagccctcttggcatgctgccctggggaccagaagcccgggatcctggcccggctgaaggacatcaaggcccaatgggaggagacagtcacctacatgactcactgtcacagccgcatcgagtgggtgtggctgcactggagcgagtacctgctggcccgagatgagttctaccgctggttccagaagatgatggtcacactggagccccacatcgagctccagctgggcctgaaggagaagcagtggcagctgagccacgcccaggtgctgctgcacaacgtggacaaccaggcggtgctcctggaccggctgctggaggaggcagcctccctgttcaacaggatcggggaccccagcgtggacgaagatgcccagaagagaatgaaggctgagtacgatgcagtgaaggccaaggcccagaagcgtgtagatctgctggagcaggtggcccgggagcatgaggagtaccaggcaggtgtggacgagttccaactgtggctgaaggcggtggtggagaaggtgaatggctgcctggggcggaactgcaagctgcccatcacgcagcgcctctccacactgcaggacattgccaaagattttcccaggggcgaggagtctctggagacgctggaggagcagtctgcgggtgtcattcggaacacctctcctttgggtgcagagaagatcaccggagaactggaagagatgaggaaagttctggagaagctgcgcgccctctgggaggaggaggaggagcggctgcggggcctgctccggtccaggggagcctgggagcagcagattaagcagctggaggctgagctcagtgagttcaggatggtcctgcagaggctggcccaggagggcctgcagcctgcggcgaaagcggggaccgaggacgagctggtggcacactggagacgctactcggcaacacgggcggcgctggcctcggaggagccccgggtggaccggctgcaagcccagctgaaggagctcatcgtcttccctcacaacctgaagccactctctgatagtgtcatcgctaccatccaggagtatcagagcctgaaggtgaagagcgcgaggctgcgcaatgccgcggcggtggagctgtggcagcatttccagcggcctctgcaggatctgcagctgtggaaggccctggcccagcggctcttggaggtcactgccagcctgccggacctgccttcccttcacaccttcctgccccagatcgaggcagccctgatggaaagctcccgcctgaaagagctgctgacgatgctgcagctgaagaaagacctcctgattggcatctttggccaggagagagccacggcactcctggagcaggtggcaggttccatgagggacagagacctgctgcataacagcctcctgcagaggaaaagcaaactgcagagcctgctcgctcagcacaaagactttggagcagcttttgagcccctgcagaggaagctcttggacctccaggtcagggtccaagccgagaaggggcttcagcgggaccttcctggaaaacaggcccagctctcaaggttgcaggtgaggggtctgtgaggcctgaatcactcctgcccaggtgctcagctgcacctggaagcagcgtctccctctagcagtaaccagcaaagcaacagctgccgtgagccagaaatttagacccttagttgagatctgacctttcacctcaacagaacctctgcttatttatctgatggttcctgacctcaaacaactgagtcttgagctcagcaaaatgacaaactgtctttctgtttactcctcagttccaaagtctaacattggtatttgtttttagaattgctttgctaagtattcttaatgagtccagaggtgttcagttaaaccaactttgggattaagaataaatgttctgaaacgtggactgtaagtaggctgaccgttgatcattgttggctggataaggaacttgatggttttttaaaatgcgcgtgatacaatagttctctctttaaaacccaagcacagctcatacataaattgagagtgttctctagaagacattaaaaatagtgcattttaggccgggagcggtggctcacgcctgtaatcccagcactttgggaggtgagcagattgcctgactttaggattttgagatcagcctgggcaacatggtgaaaccctgtctctacttaaaataaaaaattttttttaaaaaagcaaaaaatttagccaggcgtggtggcgggaatctgtaaccccagctacttgggaggccgaggcaccagaatcacttgaacccaggaggcagaggttgcagtgagcccacattgtgccactgtgctccagcctgggcgacagagtgagactctgtctccaaa

SEQ ID NO: 185344 - DNA, 2826 bp, Homo sapiens
  Payload ID: 16496
  Gene Symbol: SYNE3
  Gene Name: spectrin repeat containing, nuclear envelope family member 3
  ENST ID: ENST00000554873
  CDS Start-End: 406-2604
aaaaaaactgatgattatttatttagaaagaaaacatatcactgtcataaatggaaaagatggtgccaattccaaataggtagataaccacacaaataaatacaatgaaaccgaacggagccatttggttctatttggctccacactgtttccagctgaaggcatggaaaggaagataaacaaatgtcagaaagtgttcaagacagaagcacccaacagagactttctccttgacttaatcaaatggcttgaaaaagacttatggggaaggaatagggttctcaggttgtgagtccatgctacttaaggcagacagtccagcccttgggaaggcccctctctggctctaacgcaggactccaggaatcagtgttttgcagggcagtcccaggtctgctctggaaaatgcagcaactgtattctttttccctgcctgtttttccctcacccctctaccctcttcaggacattgccaaagattttcccaggggcgaggagtctctggagacgctggaggagcagtctgcgggtgtcattcggaacacctctcctttgggtgcagagaagatcaccggagaactggaagagatgaggaaagttctggagaagctgcgcgccctctgggaggaggaggaggagcggctgcggggcctgctccggtccaggggagcctgggagcagcagattaagcagctggaggctgagctcagtgagttcaggatggtcctgcagaggctggcccaggagggcctgcagcctgcggcgaaagcggggaccgaggacgagctggtggcacactggagacgctactcggcaacacgggcggcgctggcctcggaggagccccgggtggaccggctgcaagcccagctgaaggagctcatcgtcttccctcacaacctgaagccactctctgatagtgtcatcgctaccatccaggagtatcagagcctgaaggtgaagagcgcgaggctgcgcaatgccgcggcggtggagctgtggcagcatttccagcggcctctgcaggatctgcagctgtggaaggccctggcccagcggctcttggaggtcactgccagcctgccggacctgccttcccttcacaccttcctgccccagatcgaggcagccctgatggaaagctcccgcctgaaagagctgctgacgatgctgcagctgaagaaagacctcctgattggcatctttggccaggagagagccacggcactcctggagcaggtggcaggttccatgagggacagagacctgctgcataacagcctcctgcagaggaaaagcaaactgcagagcctgctcgctcagcacaaagactttggagcagcttttgagcccctgcagaggaagctcttggacctccaggtcagggtccaagccgagaaggggcttcagcgggaccttcctggaaaacaggcccagctctcaaggttgcaggggctgcaggaagaggggctggacttgggggcacagatggaggctgcaaggcctctggtccaggagaaccccaaccaccagcacaaaatggaccagctttcctccgacttccaggccctgcagaggtctctggaggaccttgtggacaggtgtcggcagagtgtgcaggagcactgcaccttcagccaccagctgctggagctgcggcagtggatcgttgtgaccacgcaaaagctggaggcacaccggggagaggcgggcccgggggatgccgagtcccaagaggccgagtttgagaggctggtggcagaattcccggagaaggaggcccagctgtccctggtggaagcgcagggctggctggtgatggagaagtcttctccggagggtgctgccgtggtgcaggaggagctcagggagctggcagagtcgtggcgggccttgaggctgctggaagaaagtctgctgagcctcatcagaaactggcatctgcagaggatggaagtggattcggggaagaaaatggttttcaccaacaacatcccaaagtcaggatttctcatcaatcccatggatcctattcccaggcatcgtcgacgcgcaaatcttctacaggaagaagaagggagccatgaagatttctcccagctcctgaggaactttgggcagtggttgcaggtggaaaactccaagctggttagaatcatcgcaatgagaacttctacagctgaggacttgaggaccagaaaatcgaagctgcaggagctggaggctcgggtgccagaaggtcagcatctctttgagaacctccttcgtctcgggccagcaagggggacctcggatgagctggaagatctgcgctaccagtggatgctgtacaagtccaagctgaaggactctggccacctgctgacacaaagttctccaggggagccgactggattccaaaagactcggcggtggcgaggactgggctccctcttccggagggcgtgctgtgtggcgctcccactgcagctgcttctgctgctgttcctcctcctgctgttcctgctcccaatcagggaagaggaccgcagctgcaccctggccaacaacttcgcccgctccttcacgctcatgctgcgctacaatggcccaccacccacctaacccactggggcacacaggtgactttctcctccaacctccatcagtcccagggcccctcctgaggatgctcgccagggaaactggaaacaggggcagggcaaagactgcagagctgcatccatatcagtgctgtgtcagcgttcccagaagacacttactttttatacagtgttgtcttagtctatttatactaaatgtgtactacatgtgactagggaataa

SEQ ID NO: 185345 - DNA, 1354 bp, Homo sapiens
  Payload ID: 16497
  Gene Symbol: SYNE4
  Gene Name: spectrin repeat containing, nuclear envelope family member 4
  Uniprot ID: Q8N205
  ENST ID: ENST00000324444
  CDS Start-End: 113-1327
ctgcagcctcaggcccgggtgactccagcggaggagctctgggacacccttgtctagggaagaggtcttactggctgccctcacctgactttgtgtccccaggcccccagccatggccctgtccctgcctctgggccctagacttggctcagagcccctcaaccacccaccgggagcacctagagaggcggacattgttggatgcaccgtctgccccgcgtccggagaggagagcacgagcccagagcaggcccagaccctgggacaggactccttgggccctcctgagcacttccagggtgggccaaggggcaatgagcctgccgctcaccccccgagatggtcaacaccctcttcctacgaggacccagctgggggcaaacactgtgagcaccccatttctggcctggaggtactagaggctgagcagaacagcctgcacctgtgcctgctggggctgggccgccggctgcaggacctggagcaaggcctggggcactgggcattggcccagagtgggatggtgcagctgcaggccctccaggtggacctacgaggggcagctgagcgtgtggaggcgctgctagcgtttggtgaggggctggcacagcggagtgagcccagggcctgggcagccctggagcagatcctgcgggccctgggagcttaccgagactccatcttccggcggctctggcagctgcaggcccagctggtcagctacagcctggtgttcgaggaggccaacacgctggaccaggacttggaggtcgagggagactcggactggccaggacctggtggggtctgggggccctgggcacccagtagcctccccacttccacagagttggagtgggatccggcgggggacattgggggccttgggcccttgggacaaaagacagcccggacactaggagtgccctgtgagctgtgtggccagagggggccccagggcaggggacaaggccttgaggaagcagacacctctcactcccgacaggacatgctggagtctggcctcggccaccagaaacgcttagcacgtcaccaaagacactccctgctccggaagcctcaggacaagaagaggcaagcatctcctcatctccaggatgtgaggctggaggggaatccaggggcccccgatcctgcatccaggcagcctctgaccttcctccttatcctcttcctcctcttcctcctcctggtgggtgccatgtttctcctgcccgcgtcaggaggcccctgctgctctcatgcccgaatacccaggacaccctacctggtgctcagctatgtcaatggtcttcccccagtctgatgtgtgtaataaatggtcactgtcaaa

SEQ ID NO: 185346 - DNA, 1004 bp, Homo sapiens
  Payload ID: 16497
  Gene Symbol: SYNE4
  Gene Name: spectrin repeat containing, nuclear envelope family member 4
  Uniprot ID: Q8N205
  ENST ID: ENST00000340477
  CDS Start-End: 102-977
ggcccgggtgactccagcggaggagctctgggacacccttgtctagggaagaggtcttactggctgccctcacctgactttgtgtccccaggcccccagccatggccctgtccctgcctctgggccctagacttggctcagagcccctcaaccacccaccgggagcacctagagaggcggacattgttggatgcaccgtctgccccgcgtccggagaggagagcacgagcccagagcaggcccagaccctgggacaggactccttgggccctcctgagcacttccagggtgggccaaggggcaatgagcctgccgctcaccccccgagatggtcaacaccctcttcctacgaggacccagctgggggcaaacactgtgaggtgttcgaggaggccaacacgctggaccaggacttggaggtcgagggagactcggactggccaggacctggtggggtctgggggccctgggcacccagtagcctccccacttccacagagttggagtgggatccggcgggggacattgggggccttgggcccttgggacaaaagacagcccggacactaggagtgccctgtgagctgtgtggccagagggggccccagggcaggggacaaggccttgaggaagcagacacctctcactcccgacaggacatgctggagtctggcctcggccaccagaaacgcttagcacgtcaccaaagacactccctgctccggaagcctcaggacaagaagaggcaagcatctcctcatctccaggatgtgaggctggaggggaatccaggggcccccgatcctgcatccaggcagcctctgaccttcctccttatcctcttcctcctcttcctcctcctggtgggtgccatgtttctcctgcccgcgtcaggaggcccctgctgctctcatgcccgaatacccaggacaccctacctggtgctcagctatgtcaatggtcttcccccagtctgatgtgtgtaataaatggtcactgtcaaa

SEQ ID NO: 185347 - DNA, 382 bp, Homo sapiens
  Payload ID: 16497
  Gene Symbol: SYNE4
  Gene Name: spectrin repeat containing, nuclear envelope family member 4
  ENST ID: ENST00000397428
  CDS Start-End: 28-382
agcacctagagaggcggacattgttggatgcaccgtctgccccgcgtccggagaggagagcacgaggaagcagacacctctcactcccgacaggacatgctggagtctggcctcggccaccagaaacgcttagcacgtcaccaaagacactccctgctccggaagcctcagggcccccgatcctgcatccaggcagcctctgaccttcctccttatcctcttcctcctcttcctcctcctggtgggtgccatgtttctcctgcccgcgtcaggaggcccctgctgctctcatgcccgaatacccaggacaccctacctggtgctcagctatgtcaatggtcttcccccagtctgatgtgtgtaataaatggtcactgtcaaa

SEQ ID NO: 185348 - DNA, 1175 bp, Homo sapiens
  Payload ID: 16497
  Gene Symbol: SYNE4
  Gene Name: spectrin repeat containing, nuclear envelope family member 4
  ENST ID: ENST00000490730
  CDS Start-End: 113-1175
ctgcagcctcaggcccgggtgactccagcggaggagctctgggacacccttgtctagggaagaggtcttactggctgccctcacctgactttgtgtccccaggcccccagccatggccctgtccctgcctctgggccctagacttggctcagagcccctcaaccacccaccgggagcacctagagaggcggacattgttggatgcaccgtctgccccgcgtccggagaggagagcacgagcccagagcaggcccagaccctgggacaggactccttgggccctcctgagcacttccagggtgggccaaggggcaatgagcctgccgctcaccccccgagatggtcaacaccctcttcctacgaggacccagctgggggcaaacactgtgagcaccccatttctggcctggaggtactagaggctgagcagaacagcctgcacctgtgcctgctggggctgggccgccggctgcaggacctggagcaaggcctggggcactgggcattggcccagagtgggatggtgcagctgcaggccctccaggtggacctacgaggggcagctgagcgtgtggaggcgctgctagcgtttggtgaggggctggcacagcggagtgagcccagggcctgggcagccctggagcagatcctgcgggccctgggagcttaccgagactccatcttccggcggctctggcagctgcaggcccagctggtcagctacagcctggtgttcgaggaggccaacacgctggaccaggacttggaggtcgagggagactcggactggccaggacctggaagcagacacctctcactcccgacaggacatgctggagtctggcctcggccaccagaaacgcttagcacgtcaccaaagacactccctgctccggaagcctcaggacaagaagaggcaagcatctcctcatctccaggatgtgaggctggaggggaatccaggggcccccgatcctgcatccaggcagcctctgaccttcctccttatcctcttcctcctcttcctcctcctggtgggtgccatgtttctcctgcccgcgtcaggaggcccctgctgctctcatgcccgaatacccaggacaccctacctggtgctcagctatgtcaatggtcttcccccagtctgatgtgtgtaataaatggtcactgtcaaa

SEQ ID NO: 185349 - DNA, 453 bp, Homo sapiens
  Payload ID: 16497
  Gene Symbol: SYNE4
  Gene Name: spectrin repeat containing, nuclear envelope family member 4
  ENST ID: ENST00000503121
  CDS Start-End: 1-453
cagagcccctcaaccacccaccgggagcacctagagaggcggacattgttggatgcaccgtctgccccgcgtccggagaggagagcacgagcccagagcaggcccagaccctgggacaggactccttgggccctcctgagcacttccagggtgggccaaggggcaatgagcctgccgctcaccccccgagatggtcaacaccctcttcctacgaggacccagctgggggcaaacactgtgagggcccccgatcctgcatccaggcagcctctgaccttcctccttatcctcttcctcctcttcctcctcctggtgggtgccatgtttctcctgcccgcgtcaggaggcccctgctgctctcatgcccgaatacccaggacaccctacctggtgctcagctatgtcaatggtcttcccccagtctgatgtgtgtaataaatggtcactgtcaaa

SEQ ID NO: 185350 - DNA, 7999 bp, Homo sapiens
  Payload ID: 16498
  Gene Symbol: SPTA1
  Gene Name: spectrin, alpha, erythrocytic 1
  Uniprot ID: P02549
  ENST ID: ENST00000368147
  CDS Start-End: 182-7441
tgtcgattgtgtatggctgatgggattctaggaccaagcaagaggtttttttttttcccccacatacttaacgtttctatatttctatttgaattcgactggacagttccatttgaattatttctctctctctctctctctgacacattttatcttgccaggttctaaacctttaggaaaaatggagcaatttccaaaggaaaccgttgtggagagcagtgggccaaaggttttggaaacagcagaagagatccaggagaggcgtcaggaagtgttgactcggtatcaaagtttcaaggagcgggtcgctgagaggggtcagaagcttgaggattcctatcacttacaagttttcaagcgagatgcagatgatctggggaagtggatcatggagaaagtcaatatcttaaccgataagagctatgaagacccaactaatatacaggggaaatatcagaagcatcaatcccttgaagcagaggtgcaaacaaaatcaagactcatgtctgaactggaaaaaacaagggaagaacgatttaccatgggtcattctgcccacgaagaaacgaaggcccatatagaggagctacgccacctgtgggacctgctgttagagctgaccctggagaagggtgaccagttgctgcgggccctgaagttccagcagtatgtacaggagtgtgctgacatcttagagtggattggagacaaggaggctatagcgacatcagtggagctaggtgaagactgggagcgcaccgaagttctgcataagaaatttgaagacttccaagtggagctggtagctaaagaagggagagttgttgaagtgaaccaatatgccaatgagtgtgccgaggaaaaccatcctgacctacccttaattcagtctaagcaaaatgaggtgaatgctgcctgggagcgccttcgtggtttggctctccagagacagaaagctctgtccaatgctgcaaacttacaacgattcaaaagggatgtgactgaagccatccagtggatcaaggagaaggaacctgtactcacctctgaggactatggcaaagaccttgttgcctctgaaggactgtttcacagtcacaagggacttgagagaaatcttgctgtcatgagtgacaaggtgaaggagttatgtgctaaagcagagaagctgacactttcccatccttcagatgcacctcagatccaggagatgaaagaagatctggtctccagctgggagcatattcgtgccctggccaccagcagatatgaaaaactgcaggctacttattggtaccatcgattttcatctgactttgatgaactctcaggctggatgaacgagaagactgctgcgatcaatgctgatgagctgccaacagatgtggctggtggagaagttctgctggacaggcatcagcagcataagcatgagattgactcttacgatgaccgatttcaatctgctgatgagactggtcaagacctcgtgaatgccaatcatgaagcctctgatgaagttcgggaaaagatggaaatacttgacaacaactggactgccctgctggaactgtgggacgagcgtcatcgtcagtatgagcagtgcttggactttcatctcttctacagagacagtgagcaagtggacagttggatgagtagacaagaggccttcctggaaaacgaggatctgggaaactcactgggcagtgcagaagcccttcttcagaagcatgaagactttgaggaagcctttactgcccaggaagagaagatcataactgtagacaagactgcaaccaaattgattggtgatgaccattatgattcagagaacatcaaggctatccgtgacgggctgttagcccggcgggatgccctacgtgaaaaggctgccactagacgtagattgctgaaggagtcattgcttctgcaaaaactgtatgaggactcagatgacctaaagaactggatcaacaagaagaaaaagttggcagatgatgaagattacaaggacatacagaacttgaagagcagggttcaaaagcagcaagtctttgaaaaggagttggcagttaataagacccagctggaaaacatacagaaaactggccaagagatgattgagggtggtcactatgcctctgacaatgtgaccactcgtctgagtgaagttgccagcctctgggaggagttgctggaggctacaaaacagaaagggacccagttgcatgaggccaaccagcagctgcaatttgaaaataatgcagaagatttgcagcgctggctggaggatgttgagtggcaagtcacctctgaggattatgggaaaggcctggccgaggtacagaatcgactcaggaaacacggcctcctggagtcggctgtggctgctcgtcaggatcaggtggatatccttacagacctggctgcatattttgaagaaataggccatcctgattctaaggatataagggcaaggcaagagtccttggtatgccgatttgaagctctgaaagagccactggccacccgaaagaagaagctcttagaccttctccatctgcagctgatttgtagagacacagaggatgaggaggcctggatccaagagactgaaccctcagctacttccacctaccttggaaaggacctgattgcttccaaaaagcttctgaataggcatagagtcatcctggagaacattgccagccatgaaccacgcattcaagagataacagaaaggggaaacaaaatggtagaggaaggacactttgctgcagaagatgtggcctctagggtcaagagtttgaaccagaatatggagtctctccgtgctcgagctgctaggcgacaaaatgatcttgaagccaatgtccagttccagcagtacctggctgacctgcatgaagcagaaacatggatcagagagaaggaacctattgtagataatactaactatggtgctgatgaagaagcagctggggctcttctaaagaagcatgaggcctttctattagatctcaattcatttggagacagtatgaaagctctgcggaatcaggcaaacgcctgccagcaacaacaggctgcaccagtggagggagttgctggagaacaaagggtcatggctttatatgacttccaggcccgcagcccccgagaagtcaccatgaagaaaggtgatgtcttaacgctgctcagttccatcaataaggactggtggaaggtggaagctgctgatcatcagggcattgtcccagctgtctatgtcagaagactggcccacgatgagttcccgatgctcccacagcggcgacgagaagagccaggaaacatcacccagcgccaggagcagattgagaaccaataccgctccctcttggatcgggcagaagaacgcagacgtcgtctattgcaacgttataatgaatttttattggcctatgaggcaggagacatgctggaatggattcaagagaaaaaggcagaaaacactggagtggaactagatgatgtttgggagctgcagaaaaagtttgatgagttccaaaaggatttgaataccaatgagcctcggctaagggatatcaacaaggtagctgatgatctactatttgaaggacttctaacaccagaaggagctcaaatccggcaggaattgaattcccgctggggttctttgcagaggcttgcagatgaacagcggcagctgctgggcagtgcccatgctgttgaagtgtttcacagagaagcagatgacacgaaggagcagattgagaagaaatgccaggccctcagtgctgcagaccctggctcagatctgttcagtgttcaggctcttcagcgacggcatgagggctttgaaagggacctcgtacccctgggagataaggtgaccatactgggggagacagcagagcggctcagtgagtcccatccagatgccactgaggacctgcagagacagaaaatggagctgaatgaggcctgggaagacctgcaggggcgtacaaaggatcgtaaggagagcctaaatgaggcccagaaattctacctgttcctcagcaaggccagggatctgcagaactggatcagtagcattggtggcatggtatcatcacaggagctggccgaagacttaactggcatagagatcttgctggagagacatcaggagcaccgtgctgacatggaggcagaggctcccaccttccaggccttagaggacttcagtgcagaacttatcgacagtgggcaccatgctagccctgaaattgaaaaaaagcttcaagctgtcaagctagagagagatgatttggagaaggcttgggaaaaacgcaagaagatcctagaccagtgcctggagttgcagatgttccaggggaactgtgatcaagttgagagctggatggtggcacgtgagaattccctgaggtcagatgacaaaagttccttagacagtctggaggctttgatgaagaaacgggacgatttggacaaagcaatcactgcccaggaagggaagatcactgacctagaacattttgctgagagcctcattgctgatgaacactatgccaaagaagagattgctacgcggctccaacgtgtactagacaggtggaaggctctcaaagcacaactgattgatgagcggacaaagcttggagactatgccaacctaaaacaattctaccgagaccttgaggagctggaagaatggatcagtgagatgctgcccacagcctgtgatgaatcctacaaagacgccactaacattcagaggaaatacctgaaacaccagacctttgcacatgaagtcgatggccgatctgagcaggtgcatggcgtcatcaacctggggaactccctgattgagtgtagcgcttgtgatggcaatgaagaggccatgaaggagcaactggaacagctgaaggaacattgggatcatctgcttgagagaacaaatgacaaagggaagaagctcaatgaggccagtcgtcaacagaggttcaacacaagcatccgggactttgagttctggctctcagaggcagagacattgctggccatgaaagatcaggccagggacttggcttcagcaggaaacctactcaagaagcatcagctattggagagagagatgttggctcgagaggatgcactcaaggacctgaatacattggctgaagatttgctctccagcgggactttcaacgttgatcagattgtgaagaaaaaagataatgtcaacaagcgtttcctgaatgtccaagaattggcagctgcacaccacgaaaaattgaaagaggcctatgccttgttccagttcttccaggatctagatgatgaggaatcctggatagaggagaagttgatacgagtgagctcccaggactatgggagagatcttcagggggttcagaacttgctgaagaagcacaaacgcctagagggggagctggtggcccatgagcctgccatccagaatgtgctggatatggcagagaagctgaaagacaaggctgctgtggggcaagaggagatccagttgcggctggctcagtttgttgaacactgggagaagctcaaagagttggccaaggcccgaggacttaagttggaagaatccctagaatacttgcaattcatgcagaatgctgaggaagaggaagcttggatcaatgaaaagaatgctttggctgtccgaggagattgtggagatacattagctgctactcagagcttgctaatgaagcatgaagctttggaaaatgactttgctgtccatgagacccgagtacaaaatgtgtgtgcacaaggagaagacatcctaaataaggtgttgcaggaggaaagtcagaacaaagagatttcttccaagatagaggctctgaatgaaaagaccccttctctggctaaggcaatagctgcttggaagttgcaattggaagacgattatgcctttcaggaattcaactggaaggctgatgtggtagaggcttggatagctgataaggaaacaagcctaaagaccaatggcaatggtgcagaccttggtgacttcctcactcttctggcaaaacaggacactctggatgccagtctgcagagtttccagcaagagagacttcccgagatcactgacctgaaggacaaactgatttctgctcaacacaaccagtctaaagccattgaagagcgttatgccgctctgctgaagcgctgggaacagttgctggaagcctcggcagtccacagacagaaattgctggagaaacagctgcctctacagaaggctgaggacctgttcgtggaatttgcacataaggcttcagctttgaacaactggtgtgaaaagatggaagaaaacttgtcagagcctgtgcactgtgtctccctgaatgaaattcggcagctgcagaaagaccatgaggacttcttggcctccctggctagggctcaagcagactttaaatgtttgctggagctagaccagcagattaaggccttaggtgtgccttccagcccttatacctggttaacagtggaggtgctggaaaggacctggaagcacctatctgacatcattgaggaacgggagcaggagctgcaaaaggaagaggcaagacaggtcaagaactttgagatgtgtcaggagtttgaacagaatgccagtaccttccttcaatggatcctggaaaccagggcttactttctggatggatcattgctcaaagaaacaggaactctggaatctcagctggaagcaaataaaagaaaacagaaggagatccaggcgatgaagcgtcaactaaccaagattgtggacctgggggacaacttggaagacgctctgatccttgatatcaaatacagcaccattggattggctcagcagtgggaccagctctaccagcttgggttgcggatgcaacacaacctggagcaacagatccaggccaaggacatcaaaggtgtgagtgaagagactctaaaggaatttagcacaatctataaacactttgatgagaatttgacagggcgcctgactcacaaagagttccggtcctgcctgagaggactcaattactacttgcccatggtggaggaggatgaacatgagcccaagtttgagaagttcctggatgctgtggatccagggaggaagggctatgtctcactggaggactatactgctttcctgattgacaaggagtcagaaaacatcaagtccagtgatgaaatagagaatgccttccaagccctggcagagggcaagtcatatattaccaaagaagacatgaagcaggcccttaccccagagcaagtgtcattctgtgccacacatatgcagcaatatatggacccacggggtcgaagccatctctctggctatgactacgttggcttcaccaattcctactttggcaactaataagcagctcctcgtggatcgtagaaaatcttagtgtcgtgggaaatttactggggggcaaagagtacaggcaaatgtggaagataaagatggcctcgtgtgtgtgtgtgtgtgtgtgtgtgtgtgtgtgtgcttgtgtttgtgtgcatattacatttattgtaggatcttaaaaaatctcaagggtgggagatagaaaggttaatagagttggaggagtggaagctattttgtatgcaactagtcactgctgaggggtgtcaaagtttctatttttatttgttctgttttgcacgtctttatcattttgctttattccgattatagaataaagtaattctttttaaaaatattttttggggcaaagttaagtaaaatgttgagcttctatatttctgggaactgtactcatataagagtgggcagctaattttactgtaaagaagggccatggtatagtagataaataaaatccaaggcaattttcaaacaatttttttaaactttggaatgtgtttaaatttaaatttgaaaataaagatatttgattttctgggg

SEQ ID NO: 185351 - DNA, 465 bp, Homo sapiens
  Payload ID: 16498
  Gene Symbol: SPTA1
  Gene Name: spectrin, alpha, erythrocytic 1
  ENST ID: ENST00000467387
  CDS Start-End: 92-465
gaattcgactggacagttccatttgaattatttctctctctctctctctctgacacattttatcttgccaggttctaaacctttaggaaaaatggagcaatttccaaaggaaaccgttgtggagagcagtgggccaaaggttttggaaacagcagaagagatccaggagaggcgtcaggaagtgttgactcggtatcaaagtttcaaggagcgggtcgctgaggaaaaccatcctgacctacccttaattcagtctaagcaaaatgaggtgaatgctgcctgggagcgccttcgtggtttggctctccagagacagaaagctctgtccaatgctgcaaacttacaacgattcaaaagggatgtgactgaagccatccagtggatcaaggagaaggaacctgtactcacctctgaggactatggcaaagaccttgttgcctctgaaggactgtttcacagtcacaa

SEQ ID NO: 185352 - DNA, 7998 bp, Homo sapiens
  Payload ID: 16498
  Gene Symbol: SPTA1
  Gene Name: spectrin, alpha, erythrocytic 1
  ENST ID: ENST00000614909
  CDS Start-End: 182-7474
tgtcgattgtgtatggctgatgggattctaggaccaagcaagaggtttttttttttcccccacatacttaacgtttctatatttctatttgaattcgactggacagttccatttgaattatttctctctctctctctctctgacacattttatcttgccaggttctaaacctttaggaaaaatggagcaatttccaaaggaaaccgttgtggagagcagtgggccaaaggttttggaaacagcagaagagatccaggagaggcgtcaggaagtgttgactcggtatcaaagtttcaaggagcgggtcgctgagaggggtcagaagcttgaggattcctatcacttacaagttttcaagcgagatgcagatgatctggggaagtggatcatggagaaagtcaatatcttaaccgataagagctatgaagacccaactaatatacaggggaaatatcagaagcatcaatcccttgaagcagaggtgcaaacaaaatcaagactcatgtctgaactggaaaaaacaagggaagaacgatttaccatgggtcattctgcccacgaagaaacgaaggcccatatagaggagctacgccacctgtgggacctgctgttagagctgaccctggagaagggtgaccagttgctgcgggccctgaagttccagcagtatgtacaggagtgtgctgacatcttagagtggattggagacaaggaggctatagcgacatcagtggagctaggtgaagactgggagcgcaccgaagttctgcataagaaatttgaagacttccaagtggagctggtagctaaagaagggagagttgttgaagtgaaccaatatgccaatgagtgtgccgaggaaaaccatcctgacctacccttaattcagtctaagcaaaatgaggtgaatgctgcctgggagcgccttcgtggtttggctctccagagacagaaagctctgtccaatgctgcaaacttacaacgattcaaaagggatgtgactgaagccatccagtggatcaaggagaaggaacctgtactcacctctgaggactatggcaaagaccttgttgcctctgaaggactgtttcacagtcacaagggacttgagagaaatcttgctgtcatgagtgacaaggtgaaggagttatgtgctaaagcagagaagctgacactttcccatccttcagatgcacctcagatccaggagatgaaagaagatctggtctccagctgggagcatattcgtgccctggccaccagcagatatgaaaaactgcaggctacttattggtaccatcgattttcatctgactttgatgaactctcaggctggatgaacgagaagactgctgcgatcaatgctgatgagctgccaacagatgtggctggtggagaagttctgctggacaggcatcagcagcataagcatgagattgactcttacgatgaccgatttcaatctgctgatgagactggtcaagacctcgtgaatgccaatcatgaagcctctgatgaagttcgggaaaagatggaaatacttgacaacaactggactgccctgctggaactgtgggacgagcgtcatcgtcagtatgagcagtgcttggactttcatctcttctacagagacagtgagcaagtggacagttggatgagtagacaagaggccttcctggaaaacgaggatctgggaaactcactgggcagtgcagaagcccttcttcagaagcatgaagactttgaggaagcctttactgcccaggaagagaagatcataactgtagacaagactgcaaccaaattgattggtgatgaccattatgattcagagaacatcaaggctatccgtgacgggctgttagcccggcgggatgccctacgtgaaaaggctgccactagacgtagattgctgaaggagtcattgcttctgcaaaaactgtatgaggactcagatgacctaaagaactggatcaacaagaagaaaaagttggcagatgatgaagattacaaggacatacagaacttgaagagcagggttcaaaagcagcaagtctttgaaaaggagttggcagttaataagacccagctggaaaacatacagaaaactggccaagagatgattgagggtggtcactatgcctctgacaatgtgaccactcgtctgagtgaagttgccagcctctgggaggagttgctggaggctacaaaacagaaagggacccagttgcatgaggccaaccagcagctgcaatttgaaaataatgcagaagatttgcagcgctggctggaggatgttgagtggcaagtcacctctgaggattatgggaaaggcctggccgaggtacagaatcgactcaggaaacacggcctcctggagtcggctgtggctgctcgtcaggatcaggtggatatccttacagacctggctgcatattttgaagaaataggccatcctgattctaaggatataagggcaaggcaagagtccttggtatgccgatttgaagctctgaaagagccactggccacccgaaagaagaagctcttagaccttctccatctgcagctgatttgtagagacacagaggatgaggaggcctggatccaagagactgaaccctcagctacttccacctaccttggaaaggacctgattgcttccaaaaagcttctgaataggcatagagtcatcctggagaacattgccagccatgaaccacgcattcaagagataacagaaaggggaaacaaaatggtagaggaaggacactttgctgcagaagatgtggcctctagggtcaagagtttgaaccagaatatggagtctctccgtgctcgagctgctaggcgacaaaatgatcttgaagccaatgtccagttccagcagtacctggctgacctgcatgaagcagaaacatggatcagagagaaggaacctattgtagataatactaactatggtgctgatgaagaagcagctggggctcttctaaagaagcatgaggcctttctattagatctcaattcatttggagacagtatgaaagctctgcggaatcaggcaaacgcctgccagcaacaacaggctgcaccagtggagggagttgctggagaacaaagggtcatggctttatatgacttccaggcccgcagcccccgagaagtcaccatgaagaaaggtgatgtcttaacgctgctcagttccatcaataaggactggtggaaggtggaagctgctgatcatcagggcattgtcccagctgtctatgtcagaagactggcccacgatgagttcccgatgctcccacagcggcgacgagaagagccaggaaacatcacccagcgccaggagcagattgagaaccaataccgctccctcttggatcgggcagaagaacgcagacgtcgtctattgcaacgttataatgaatttttattggcctatgaggcaggagacatgctggaatggattcaagagaaaaaggcagaaaacactggagtggaactagatgatgtttgggagctgcagaaaaagtttgatgagttccaaaaggatttgaataccaatgagcctcggctaagggatatcaacaaggtagctgatgatctactatttgaaggacttctaacaccagaaggagctcaaatccggcaggaattgaattcccgctggggttctttgcagaggcttgcagatgaacagcggcagctgctgggcagtgcccatgctgttgaagtgtttcacagagaagcagatgacacgaaggagcagattgagaagaaatgccaggccctcagtgctgcagaccctggctcagatctgttcagtgttcaggctcttcagcgacggcatgagggctttgaaagggacctcgtacccctgggagataaggtgaccatactgggggagacagcagagcggctcagtgagtcccatccagatgccactgaggacctgcagagacagaaaatggagctgaatgaggcctgggaagacctgcaggggcgtacaaaggatcgtaaggagagcctaaatgaggcccagaaattctacctgttcctcagcaaggccagggatctgcagaactggatcagtagcattggtggcatggtatcatcacaggagctggccgaagacttaactggcatagagatcttgctggagagacatcaggagcaccgtgctgacatggaggcagaggctcccaccttccaggccttagaggacttcagtgcagaacttatcgacagtgggcaccatgctagccctgaaattgaaaaaaagcttcaagctgtcaagctagagagagatgatttggagaaggcttgggaaaaacgcaagaagatcctagaccagtgcctggagttgcagatgttccaggggaactgtgatcaagttgagagctggatggtggcacgtgagaattccctgaggtcagatgacaaaagttccttagacagtctggaggctttgatgaagaaacgggacgatttggacaaagcaatcactgcccaggaagggaagatcactgacctagaacattttgctgagagcctcattgctgatgaacactatgccaaagaagagattgctacgcggctccaacgtgtactagacaggtggaaggctctcaaagcacaactgattgatgagcggacaaagcttggagactatgccaacctaaaacaattctaccgagaccttgaggagctggaagaatggatcagtgagatgctgcccacagcctgtgatgaatcctacaaagacgccactaacattcagaggaaatacctgaaacaccagacctttgcacatgaagtcgatggccgatctgagcaggtgcatggcgtcatcaacctggggaactccctgattgagtgtagcgcttgtgatggcaatgaagaggccatgaaggagcaactggaacagctgaaggaacattgggatcatctgcttgagagaacaaatgacaaagggaagaagctcaatgaggccagtcgtcaacagaggttcaacacaagcatccgggactttgagttctggctctcagaggcagagacattgctggccatgaaagatcaggccagggacttggcttcagcaggaaacctactcaagaagcatcagctattggagagagagatgttggctcgagaggatgcactcaaggacctgaatacattggctgaagatttgctctccagcgggactttcaacgttgatcagattgtgaagaaaaaagataatgtcaacaagcgtttcctgaatgtccaagaattggcagctgcacaccacgaaaaattgaaagaggcctatgccttgttccagttcttccaggatctagatgatgaggaatcctggatagaggagaagttgatacgagtgagctcccaggactatgggagagatcttcagggggttcagaacttgctgaagaagcacaaacgcctagagggggagctggtggcccatgagcctgccatccagaatgtgctggatatggcagagaagctgaaagacaaggctgctgtggggcaagaggagatccagttgcggctggctcagtttgttgaacactgggagaagctcaaagagttggccaaggcccgaggacttaagttggaagaatccctagaatacttgcaattcatgcagaatgctgaggaagaggaagcttggatcaatgaaaagaatgctttggctgtccgaggagattgtggagatacattagctgctactcagagcttgctaatgaagcatgaagctttggaaaatgactttgctgtccatgagacccgagtacaaaatgtgtgtgcacaaggagaagacatcctaaataaggtgttgcaggaggaaagtcagaacaaagagatttcttccaagatagaggctctgaatgaaaagaccccttctctggctaaggcaatagctgcttggaagttgcaattggaagacgattatgcctttcaggaattcaactggaaggctgatgtggtagaggcttggatagctgataaggaaacaagcctaaagaccaatggcaatggtgcagaccttggtgacttcctcactcttctggcaaaacaggacactctggatgccagtctgcagagtttccagcaagagagacttcccgagatcactgacctgaaggacaaactgatttctgctcaacacaaccagtctaaagccattgaagagcgttatgccgctctgctgaagcgctgggaacagttgctggaagcctcggcagtccacagacagaaattgctggagaaacagctgcctctacagaaggctgaggacctgttcgtggaatttgcacataaggcttcagctttgaacaactggtgtgaaaagatggaagaaaacttgtcagagcctgtgcactgtgtctccctgaatgaaattcggcagctgcagaaagaccatgaggacttcttggcctccctggctagggctcaagcagactttaaatgtttgctggagctagaccagcagattaaggccttaggtgtgccttccagcccttatacctggttaacagtggaggtgctggaaaggacctggaagcacctatctgacatcattgaggaacgggagcaggagctgcaaaaggaagaggcaagacaggtcaagaactttgagatgtgtcaggagtttgaacagaatgccagtaccttccttcaatggatcctggaaaccagggcttactttctggatggatcattgctcaaagaaacaggaactctggaatctcagctggaagcaaataaaagaaaacagaaggagatccaggcgatgaagcgtcaactaaccaagattgtggacctgggggacaacttggaagacgctctgatccttgatatcaaatacagcaccattggattggctcagcagtgggaccagctctaccagcttgggttgcggatgcaacacaacctggagcaacagatccaggccaaggacatcaaaggtgtgagtgaagagactctaaaggaatttagcacaatctataaacactttgatgagaatttgacagggcgcctgactcacaaagagttccggtcctgcctgagaggactcaattactacttgcccatggtggaggaggatgaacatgagcccaagtttgagaagttcctggatgctgtggatccagggaggaagggctatgtctcactggaggactatactgctttcctgattgacaaggagtcagaaaacatcaagtccagtgatgaaatagagaatgccttccaagccctggcagagggcaagtcatatattaccaaagaagacatgaagcaggcccttaccccagagcaagtgtcattctgtgccacacatatgcagcaatatatggacccacgggtcgaagccatctctctggctatgactacgttggcttcaccaattcctactttggcaactaataagcagctcctcgtggatcgtagaaaatcttagtgtcgtgggaaatttactggggggcaaagagtacaggcaaatgtggaagataaagatggcctcgtgtgtgtgtgtgtgtgtgtgtgtgtgtgtgtgtgcttgtgtttgtgtgcatattacatttattgtaggatcttaaaaaatctcaagggtgggagatagaaaggttaatagagttggaggagtggaagctattttgtatgcaactagtcactgctgaggggtgtcaaagtttctatttttatttgttctgttttgcacgtctttatcattttgctttattccgattatagaataaagtaattctttttaaaaatattttttggggcaaagttaagtaaaatgttgagcttctatatttctgggaactgtactcatataagagtgggcagctaattttactgtaaagaagggccatggtatagtagataaataaaatccaaggcaattttcaaacaatttttttaaactttggaatgtgtttaaatttaaatttgaaaataaagatatttgattttctgggg

SEQ ID NO: 185353 - DNA, 7794 bp, Homo sapiens
  Payload ID: 16499
  Gene Symbol: SPTAN1
  Gene Name: spectrin, alpha, non-erythrocytic 1
  Uniprot ID: Q13813
  ENST ID: ENST00000358161
  CDS Start-End: 108-7466
acccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgcactgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcaatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtctcatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctagcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaaccggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 185354 - DNA, 7889 bp, Homo sapiens
  Payload ID: 16499
  Gene Symbol: SPTAN1
  Gene Name: spectrin, alpha, non-erythrocytic 1
  Uniprot ID: Q13813
  ENST ID: ENST00000372731
  CDS Start-End: 143-7561
tataaaagaggcggggcgcgcgcgtcgccgccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgcactgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtctcatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctagcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaaccggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccccaaa

SEQ ID NO: 185355 - DNA, 7868 bp, Homo sapiens
  Payload ID: 16499
  Gene Symbol: SPTAN1
  Gene Name: spectrin, alpha, non-erythrocytic 1
  Uniprot ID: Q13813
  ENST ID: ENST00000372739
  CDS Start-End: 111-7544
actacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgcactgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtctcatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagctttccaagctgctgagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctagcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaaccggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttcccc

SEQ ID NO: 185356 - DNA, 7812 bp, Homo sapiens
  Payload ID: 16499
  Gene Symbol: SPTAN1
  Gene Name: spectrin, alpha, non-erythrocytic 1
  ENST ID: ENST00000630804
  CDS Start-End: 114-7487
gccactacccgctgcggagtgaacggtgtggagcggaggccgcggaggctcctcggtccttcagcacccctcggcccgacgcacccacgcccctcaccccccgagagccgaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgcactgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcaatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtctcatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagctttccaagctgctgagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctagcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaaccggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatgggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgagccactccctgggtcacccacccctcgctgcttgccctgcgtcgccttgctgcatgtccgctcctctgtgtgctctcactttccactgtaaccttaagcctgcttagcttggaataagacttaggagaaaatggtgcttcactaacccgcttccggtccagtcacaatcatcatgtcactgtggggacccagatctgtgtcttgaagcagctgccctcattccgacttcagaaaatcgaagcagctggctcctccccttgttctctctcccaccctcccccaaatctgttttcatgtaaaagacaaataaatgatgacttccccc

SEQ ID NO: 185357 - DNA, 585 bp, Homo sapiens
  Payload ID: 16499
  Gene Symbol: SPTAN1
  Gene Name: spectrin, alpha, non-erythrocytic 1
  ENST ID: ENST00000627441
  CDS Start-End: 126-585
actacccgctgcggagtgaacggtgtggagcggaggccgcggaggctcctcggtccttcagcacccctcggcccgacgcacccacgcccctcaccccccgagagccgactccacattcctccatcatgttgtcatcgtttcgtaaacgcagagtccagaaaatggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaag

SEQ ID NO: 185358 - DNA, 416 bp, Homo sapiens
  Payload ID: 16499
  Gene Symbol: SPTAN1
  Gene Name: spectrin, alpha, non-erythrocytic 1
  ENST ID: ENST00000630981
  CDS Start-End: 1-205
cgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccaggtatgggcctcaggaggtgggtgaagaggtgtcctttggaaaactaaagccaaatttgtggcagagctgagtctggggtaacaggccctgcgctgggtattctccccatttacaaatcaaactcagtatggacagaagtcccggatctgcttgtagaagcagctccgagcccccagcatcctgagacctgggaggtcgggtttgaagtgggtgcagctggctcaggcaccaggtg

SEQ ID NO: 185359 - DNA, 7498 bp, Homo sapiens
  Payload ID: 16499
  Gene Symbol: SPTAN1
  Gene Name: spectrin, alpha, non-erythrocytic 1
  ENST ID: ENST00000630866
  CDS Start-End: 1-7497
atggacccaagtggggtcaaagtgctggaaacagcagaggacatccaggagaggcggcagcaggtcctagaccgataccaccgcttcaaggaactctcaacccttaggcgtcagaagctggaagattcctatcgattccagttctttcaaagagatgctgaagagctggagaaatggatacaggaaaaacttcagattgcatctgatgagaattataaagacccaaccaacttgcagggaaagcttcagaagcatcaagcatttgaagctgaagtgcaggccaactcaggagccattgttaagctggatgaaactggaaacctgatgatctcagaagggcattttgcatctgaaaccatacggacccgtttgatggagctgcaccgccagtgggaattacttttggagaagatgcgagaaaaaggaatcaaactgctgcaggcccagaagttggtgcagtacttacgagaatgtgaggacgtgatggactggatcaatgacaaggaagcaattgttacttctgaagagctgggccaggatctggagcatgtagaggttttacagaagaaatttgaagagtttcaaacagatatggctgctcatgaagaaagagttaatgaagtgaaccagtttgctgccaaactcatacaggagcagcaccctgaggaggaactgatcaagactaagcaggatgaagtcaatgcagcctggcagcggctgaagggcctggctctgcagaggcaggggaagctctttggggcagcagaagttcagcgctttaacagggatgtggatgagactatcagttggattaaggaaaaggagcagttaatggcctctgatgattttggccgagacctggcaagtgttcaggctctgcttcggaagcacgagggtctggagagagatcttgctgctctagaagacaaggtcaaagccctgtgtgctgaggctgaccgcctgcaacagtcccaccctctgagtgcaacacagattcaagtgaagcgagaggaactgattacaaactgggagcagatccgcaccttggcggcagagagacatgcacggctcaatgattcatacaggcttcaacgcttccttgctgacttccgtgacctcaccagctgggtgactgagatgaaagccctcatcaatgcagatgagcttgccagtgatgtggctggggctgaagccctgctagatagacaccaagagcacaagggtgaaattgatgcccatgaagacagcttcaaatctgcagatgaatctggacaggcactgcttgctgctggtcactatgcctcagatgaagtgagggagaagctgaccgtcctttccgaggagagagcggcgctgctggagctgtgggagctgcgcaggcagcagtacgagcagtgcatggacctgcagctcttctaccgggacactgagcaggtggacaactggatgagcaagcaggaggcgttcctgttgaatgaagacttgggagattccttggatagtgtggaagcgcttcttaagaagcacgaagactttgagaaatcccttagtgcccaggaggaaaagattacagcattagatgaatttgcaaccaagctaattcagaacaaccactatgcaatggaagatgtggccactcgccgagatgctctgttgagccgccgcaatgcccttcacgagagagccatgcgtcgccgggcccagctagccgattctttccatctgcagcagtttttccgtgattctgatgagctcaagagttgggtcaatgagaagatgaaaactgccacagatgaagcttataaagatccatccaacctacaaggaaaagtacagaagcatcaggcttttgaggctgagctctcagcaaaccagagccgaattgatgccttggagaaagctggccaaaagctgattgatgtcaaccactatgccaaggatgaagtggcagctcgtatgaatgaggtgatcagtttgtggaagaaactgctagaggccactgaactgaaaggaataaagcttcgtgaagccaaccagcaacagcaatttaatcgcaatgttgaggatattgaattgtggctatatgaagtagaaggtcacttggcttcggatgattacggcaaagatcttaccaatgtgcagaacctccagaagaaacatgcactgctagaggcagatgtggctgctcaccaggaccgaattgatggcatcaccattcaggcccgccagttccaagatgctggccattttgatgcagaaaacatcaagaagaaacaggaagccctcgtggctcgctatgaggcactcaaggagcccatggttgcccggaagcagaagctggccgattctctgcggttgcagcagctcttccgggatgttgaggatgaggagacgtggattcgagagaaagagcccattgccgcatctaccaacagaggtaaggatttaattggggtccagaatctgctaaagaaacatcaagccttacaagcagaaattgctggacatgaaccacgcatcaaagcagttacacagaaggggaatgccatggtggaggaaggccattttgctgcagaggatgtgaaggccaagcttcacgagctgaaccaaaagtgggaggcactgaaagccaaagcttcccagcgtcggcaggacctggaggactctctgcaggcccagcagtactttgctgatgctaacgaggctgaatcctggatgcgggagaaggaacccattgtgggcagcactgactatggcaaggacgaagactctgctgaggctctactgaagaaacacgaagctttgatgtcagatctcagtgcctacggcagcagcatccaggctttgcgagaacaagcacagtcctgccggcaacaagtggcccccacggatgatgagactgggaaggagctggtcttggctctctacgactatcaggagaagagtccccgagaggtcaccatgaagaagggagatatccttaccttactcaacagcaccaacaaggattggtggaaagtggaagtgaacgatcgtcagggttttgtgccggctgcgtacgtgaagaaattggaccccgcccagtcagcctcccgggagaatctcctggaggagcaaggcagcatagcactgcggcaggagcagattgacaatcagacacgcataactaaggaggccggcagtgtatctctgcgtatgaagcaggtggaagaactatatcattctctgctggaactgggtgagaagcgtaaaggcatgttggagaagagttgcaagaagtttatgttgttccgtgaagcgaatgaactacagcaatggatcaatgagaaggaagccgctctgacaagtgaggaggtcggagcagacttggagcaggttgaggtgctccagaagaagtttgatgacttccagaaggacctgaaggccaatgagtcacggttgaaggacattaacaaggtagctgaagacctggagtctgaaggtctcatggcagaggaggtgcaggctgtgcaacaacaggaagtgtatggcatgatgcccagggatgaaactgattccaagacagcctccccgtggaagtctgctcgtctgatggttcacaccgtggccacctttaattccatcaaggagctgaatgagcgctggcggtccctacagcagctggccgaggaacggagccagctcttgggcagcgcccatgaagtacagaggttccacagagatgctgatgaaaccaaagaatggattgaagagaagaatcaagctctaaacacagacaattatggacatgatctcgccagtgtccaggccctgcaacgcaagcatgagggcttcgagagggaccttgcggctctcggtgacaaggtaaactcccttggtgaaacagcagagcgcctgatccagtcccatcccgagtcagcagaagacctgcaggaaaagtgcacagagttaaaccaggcctggagcagcctggggaaacgtgcagatcagcgcaaggcaaagttgggtgactcccacgacctgcagcgcttccttagcgatttccgggacctcatgtcttggatcaatggaatacgggggttggtgtcctcagatgagctagccaaggatgtcaccggagctgaggcattgctggagcgacaccaggaacaccggacagaaatcgatgccagggctggcactttccaggcatttgagcagtttggacagcagctgttggctcacggacactatgccagccctgagatcaagcagaaacttgatattcttgaccaggagcgtgcagacctggagaaggcctgggttcagcgcaggatgatgctggatcagtgccttgaactgcagctgttccatcgggactgtgagcaagctgagaactggatggctgcccgggaggccttcttgaataccgaagacaaaggagactcactggacagcgtagaggctctgatcaaaaaacatgaagactttgacaaagcgattaacgtccaggaagagaagattgctgctctgcaggcctttgccgaccagctcatcgctgccggccattatgccaagggagacatttctagccggcgcaatgaggtcttggacaggtggcgacgtctgaaagcccagatgattgagaaaaggtcaaagctaggagaatctcaaaccctccaacagttcagccgggatgtggatgagattgaggcttggatcagtgaaaaattgcaaacagcgagtgatgagtcgtacaaggatcccaccaacatccagctttccaagctgctgagcaagcaccagaagcaccaggcttttgaagcagagctgcatgccaacgctgaccggatccgtggggttatcgacatgggcaactccctcattgaacgtggagcctgtgccggcagtgaggatgctgtcaaggcccgcctggctgccttagctgaccagtggcagttcttggtgcaaaagtcagcggaaaagagccagaaactgaaagaagccaacaagcagcagaacttcaacacagggatcaaggactttgacttctggctgtctgaggtggaggccctgctggcatccgaagattatggcaaagacctagcttctgtgaacaacctgctgaaaaagcatcaactgctggaagcagatatatctgcccatgaggatcgcctgaaggacctgaacagccaggcagacagcctgatgaccagcagtgccttcgacacctcccaagtaaaggacaagagggacaccatcaacgggcgcttccagaagatcaagagcatggcggcctcccggcgagccaagctgaatgaatcccatcgcctgcaccagttcttccgggacatggatgacgaggagtcctggatcaaggagaagaagctgctggtgggctcagaggactacggccgggacctaaccggcgtgcagaacctgaggaagaagcacaagcggctggaagcagaactggctgcgcatgagccggctattcagggtgtcctggacactggcaagaagctgtccgatgacaacaccatcgggaaagaggagatccagcagcggctggcgcagtttgtggagcactggaaagagctgaagcagctggcagctgcccggggtcagcggctggaagagtccttggaatatcagcagtttgtagccaatgtggaagaggaagaagcctggatcaatgagaaaatgaccctggtggccagcgaagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaactggaaggcggacgtggtggagtcctggatcggtgaaaaggagaacagcttgaagacagatgattatggccgagacctgtcttctgtgcagacgctcctcaccaaacaggaaacttttgacgctgggctgcaggccttccagcaggaaggcattgccaacatcactgccctcaaagatcagcttctcgccgccaaacacgttcagtccaaggccatcgaggcccggcacgcctccctcatgaagaggtggagccagcttctggccaactcagccgcccgcaagaagaagcttctggaggctcagagtcacttccgcaaggtggaggacctcttcctgaccttcgccaaaaaggcttctgccttcaacagctggtttgaaaatgcagaggaggacttaacagaccccgtgcgctgcaactccttggaagaaatcaaagctttgcgcgaggcccacgacgccttccgctcctccctcagctctgcccaggctgacttcaaccagctggccgagctggaccgccagatcaagagcttccgcgtagcctccaacccctacacctggtttaccatggaggccctggaggagacctggaggaacctacagaaaatcatcaaggagagggagctggagctgcagaaggaacagcggcggcaggaggagaacgacaagctgcgccaggagtttgcccagcacgccaacgccttccaccagtggatccaagagaccaggacatacctcctcgatggcatagcatatcgtcgggtcattcgtgtctatcagtatgaagttggggatgatctgtctggaaggtcctgtatggtggaagagtcggggaccctcgaatcccagcttgaagctaccaaacgcaagcaccaggaaatccgagccatgagaagtcagctcaaaaagatcgaggacctgggggccgccatggaggaggccctcatcctggacaacaagtacacggagcacagcaccgtgggcctcgcccagcagtgggaccagctggaccagctgggcatgcgcatgcagcacaacctggagcagcagatccaggccaggaacacaacaggtgtgactgaggaggccctcaaagaattcagcatgatgtttaaacactttgacaaggacaagtctggcaggctgaaccatcaggagttcaaatcttgcctgcgctccctgggctatgacctgcccatggtggaggaaggggaacctgaccctgagttcgaggcaatcctggacacggtggatccgaacagagatggccatgtctccttgcaagaatacatggctttcatgatcagccgcgaaactgagaacgtcaagtccagcgaggagattgagagcgccttccgggccctcagctcagagggaaagccttacgtgaccaaggaggagctctaccagaacctgacccgggaacaagccgactactgcgtctcccacatgaagccctacgtggacggcaagggccgcgagctccccaccgcgttcgactacgtggagttcacccgctcgcttttcgtgaactgag

SEQ ID NO: 185360 - DNA, 6321 bp, Homo sapiens
  Payload ID: 16500
  Gene Symbol: SPTB
  Gene Name: spectrin, beta, erythrocytic
  Uniprot ID: P11277
  ENST ID: ENST00000389720
  CDS Start-End: 1-6321
atgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctggaatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccattgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacggcctcaagaggaggaaggcgagacagcaggggaggctccagtttcccaccatgcggccaccgagagaacgtccccggtcagtctctggtctcgtttgtctag

SEQ ID NO: 185361 - DNA, 6705 bp, Homo sapiens
  Payload ID: 16500
  Gene Symbol: SPTB
  Gene Name: spectrin, beta, erythrocytic
  Uniprot ID: P11277
  ENST ID: ENST00000389721
  CDS Start-End: 34-6447
tgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctggaatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccattgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccggtcagtctctggtctcgtttgtctagttcctgggagtcactgcagccagagccctctcacccctactaggctcagcccaggtggaggcgagatgagctggcgcagccccgccctccatcctccccacatccctgcagccacctcccagcagagcaggctacgtcctcactgaggtgttcttcatgagagtactagcctcctccactcctccccacagcgcagaggaaacaggccagcccagtgacatgacgttattagttttgttttacctaatgtaataaattttattgtataaatatatcaccatttacatgaggggaaacacta

SEQ ID NO: 185362 - DNA, 10063 bp, Homo sapiens
  Payload ID: 16500
  Gene Symbol: SPTB
  Gene Name: spectrin, beta, erythrocytic
  Uniprot ID: P11277
  ENST ID: ENST00000389722
  CDS Start-End: 55-7041
cagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctggaatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccattgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccgggggaagaagagggaacgtggcctcagaacctgcagcagccaccaccgccgggtcagcacaaggatgggcagaaatccactggggatgagaggcccaccacggagcccctctttaaggtcctagatacgcctctgagcgagggtgatgagcccgcaacgctgccggccccgcgggaccatgggcagagtgtgcagatggaaggctacctgggccgcaagcatgacctggaggggcccaacaagaaggcttccaacaggtcctggaacaacctgtactgtgtgctcaggaacagtgagctaaccttctacaaggatgccaagaacctggccctggggatgccctaccatggggaggaacccctggccctgagacatgccatctgtgagattgctgccaactacaagaagaagaagcacgtctttaagctgaggctgagtaatggcagcgagtggctcttccatggcaaggatgaggaggagatgctgtcctggctgcagggcgtgagcaccgccatcaacgagtcccagagcatccgcgtcaaggcgcagagcctgcccctgccttccctctccggccccgacgccagcctcggcaagaaagacaaggagaagagattcagcttcttccccaaaaagaagtagcaggtggggctggcgggcgcggcggagtcgggacgcgcagagaccgggcagcccaggccttggcctcctctcgccgccgcccgccggtcgaatcgagatgagtcgagtcgcgggccgggcccccgggccccacgctgcactgcaaaagctgccttcgcccgcgtgtcctgggccgacgccccctccatgccctcgcccgcgctggctccgctccagggacaggggctcccagctcctctggcgcctttggggcctccaggcctgggggcaggaaacggttctctgaggcacacgccctcctctcccaccctcctcctgagccgagggggcacaggccccttacccccaaccaaaaaaaaaaaaaaaaaagagctggagaaggctgatggggttcttcaaacgctgcccgttcctaaagcaagtcttgcttcgggtcacctcccacctggtggcagccagggaaaggggaaaggaagaagacactggaaatgcatggccagccccctaggggcatgaggaaggagccttcaggtggcccacaaagccctagctctgggccaggggctctggggggctgaggggaccagactgggtgcagggccttgggagctgccagcctccttcccactgggcttccgcagaactgggactctcacttcaggggccaccacatccctcctctctgcttctccccccagatcaaagggtaccctcccacggttggcagggcctggctgagtgcctctagcaccctttgtgccaccacaggcggtcccaggaagggcagcaaggtcagaccattcctcattgaaaaccgtggctagggcacagggctctgatctgaaggagtgacaggtgcgtcacaacactgcctaaggctctccctctcaatgctgggaccctcgccccactcccagtggcagccaaaccagcaatatccaacagacataggccccctacgggacagtgtgggcccccagatataagatggataccccccgcacctgcagtaaagcatcccaaagccaaatgctcaattgcatcctgtctgcagctgggactttggagggtaatggctgggcagacagtaaagttgatcatctgttttctcggggtggcagacgcagccatgtcttggtatcaccacccatgtgacagctactcctgcacaactgggacaaatgtcagggccagagccatgaaggtgtggtaccccttgatcagcttctccacgtcctggccccaggtcttggcggggagggggtcacatgagtacagaggtcaaatatctaccaccctccagccctgagcaccagaagctctgcaaccaacgtccccaggaatggccttccccttgctgctcaggtcatacttctggaggaagagaaagctcattccatattttccccaccactctactccgaaagcaacacagttctggcccagtatcaaactagggttaggtccaagagagcagtcaagcgggtcgggggtgggggggagggcggagggcagcaggcattttcccccaaggaaaccatgaaagtccccagggcctgcagtcaagtttctatcaccttccccgtgagaaggaccttagttccatggagatgaagtgggtgaggttcaggtagaagccacaggggcaggcatccagaatgaggccccctgaggaaccctgagtgctgaccagtgccggcagaaatcagttccaccctgtggccctgacactatatgtcagggtgacaccaactgcagcaggcaggagccacaggaaggaagacgtcatccgatggagcctgacatccccaggttcccgccctggtgagcaaggtcttcatttggctttggtacatatgaccctatacagggaacctagtgtgtatcactcaccagcctctttctgtatctggggaaaccaaggcagtgaggtgactgcactcacctagcaataaagtaggcctttggtgcacttgcaggcatgtcctcctctggggcagagagcaggttccttgctgaagggcagatggtggcaaacatctccctcaactgtttccctgggccagtctttagggagcctagggacaagggcccaccctcccccttccacgtgtgccaaatcagcacctgaagtgaggcatttccagcaagcaactccacagacccgagaaaggaagggctctagtggaagagctagcatctcaccaccccaggtcccctggcctggtccagggcagccagctgcatgtgaccattctgttgccagctccccacacatccctcctgtcacccaggctccaagacattcgaccaactagactgaaaatgcaggcatccagctttgggagaccctgtgtgtgccacaccagggctaagctctcccagtgccctagcaaggtctttttttttttttctctccttattctactctacagtcttttgacagtattcccaaacgaggttgacacagctccagtccacaccagcataccaggcttccttcccagggcagtttagaggaagctccttctgggcaaggtcaggcggtcctccttccctctctccttcccctttgtcccagcctcaactgactctggctgtgggaggtgtggagggtccttaggcttccctccccaacctggcctccaccaacacccctaacaggaggcccgtggaaggctcagcctctcctccgcatccctcctccttcctgcctatcggagggagccagggtcccctaggctgaccctgaatcctcttcctcccttcatgggaggggggcaggaatccagaggaggatgaagccagcgggaccacatggcttggtggcttggacaaacaagctcagggaggaaatgaggaggcggcggctgcagaggaatgcaaccctgttgggcacagaccatgcaatctggggctggccctggggccagctgggtcctgtcctccacctgctcaaccgtgcttccaccaaccagaggaaacccatttactagtttttctaataaatcaataatgctcc

SEQ ID NO: 185363 - DNA, 3456 bp, Homo sapiens
  Payload ID: 16500
  Gene Symbol: SPTB
  Gene Name: spectrin, beta, erythrocytic
  ENST ID: ENST00000553938
  CDS Start-End: 1-3087
ggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccattgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccgggggaagaagagggaacgtggcctcagaacctgcagcagccaccaccgccgggtcagcacaaggatgggcagaaatccactggggatgagaggcccaccacggagcccctctttaaggtcctagatacgcctctgagcgagggtgatgagcccgcaacgctgccggccccgcgggaccatgggcagagtgtgcagatggaaggctacctgggccgcaagcatgacctggaggggcccaacaagaaggcttccaacagtaagggagaagagggagaggagaggagggagacagaagaggaggatgaagaggaggaggaaacagagtctgttgctgtagaaatgcagcaacatgcttcccacgtgtcctggaacaacctgtactgtgtgctcaggaacagtgagctaaccttctacaaggatgccaagaacctggccctggggatgccctaccatggggaggaacccctggccctgagacatgccatctgtgagattgctgccaactacaagaagaagaagcacgtctttaagctgaggctgagtaatggcagcgagtggctcttccatggcaaggatgaggaggagatgctgtcctggctgcagggcgtgagcaccgccatcaacgagtcccagagcatccgcgtcaaggcgcagagcctgcccctgccttccctctccggccccgacgccagcctcggcaagaaagacaaggagaagagattcagcttcttccccaaaaagaagtagcaggtggggctggcgggcgcggcggagtcgggacgcgcagagaccgggcagcccaggccttggcctcctctcgccgccgcccgccggtcgaatcgagatgagtcgagtcgcgggccgggcccccgggccccacgctgcactgcaaaagctgccttcgcccgcgtgtcctgggccgacgccccctccatgccctcgcccgcgctggctccgctccagggacaggggctcccagctcctctggcgcctttggggcctccaggcctgggggcaggaaacggttctctgaggcacacgccctcctctcccaccctcctcctgagccgagggggcacaggccccttacccccaaccaaaaaaaaaaaaaaaaaa

SEQ ID NO: 185364 - DNA, 10153 bp, Homo sapiens
  Payload ID: 16500
  Gene Symbol: SPTB
  Gene Name: spectrin, beta, erythrocytic
  Uniprot ID: P11277
  ENST ID: ENST00000556626
  CDS Start-End: 144-7130
gtgccaggagccccgcgctgccctcctccccctgcgccgccgccgccgccacccccgggctcggggtggcccccgcttcagtcccagggcagggatccttccatgaagactgaggcaggcggagctgctaagagcctgctgacatgacatcggccacagagtttgaaaatgtgggcaaccagccaccttacagcaggatcaatgcccgctgggacgccccagacgacgagctggataatgacaacagctcagccaggctctttgagaggtcccggataaaggccttggcagatgagcgggaagttgttcagaaaaagaccttcacgaaatgggtgaactcgcacctggctcgagtgtcctgccgcatcaccgatctctacaaggacctgcgggatgggcgcatgctcatcaagctgctggaggtgctctctggagagatgctgccaaagcccaccaaggggaagatgcgcatccactgcctggagaatgtggacaaggctctccagttcctcaaggagcagcgtgtacacctggagaacatgggctcccacgacattgtagatggcaaccaccgcctggtcctgggcctcatctggaccatcatcctccgcttccagattcaggacattgtggtccaaactcaggaaggtcgtgaaacacgctcagccaaggatgcgttgctgttgtggtgtcagatgaagacggcaggctaccctcatgttaatgtcaccaactttacctccagctggaaggatggcttggcctttaatgccctgatacacaagcaccggcccgacctgatcgactttgataagctgaaggactccaatgcccggcacaacctggagcacgcattcaatgtggctgagcgccagctgggcatcatcccgctcctcgaccccgaagatgtctttacggaaaaccctgatgagaaatccatcatcacctatgtggtggccttttaccactacttctccaagatgaaggtgctggcagtggagggcaagcgtgtcggcaaggttattgaccatgccattgagactgagaagatgattgaaaagtacagcgggctagcctcggacctgctcacctggatcgagcagaccatcactgtcctgaacagccgcaagtttgccaactcgctgacgggcgtccagcagcagctgcaggccttcagcacctaccgcaccgtggagaagccgcccaagtttcaagagaaggggaatctggaagttctactttttaccatccagtcccggatgagagccaacaatcagaaagtgtacacaccccacgatgggaaactagtgtctgacatcaacagggcctgggaaagcctggaggaagctgagtatcggcgggagctggccctgagaaatgagctcattcggcaggagaagctagagcaactggcccggcgctttgaccggaaggccgcaatgagagagacctggctcagtgaaaaccagcgcctcgtggcccaggataactttgggtatgacctggcagctgtggaggccgccaagaagaagcatgaggccatcgagaccgacacggctgcctacgaggagcgggtgagagccctggaggacctggctcaggagctggagaaagagaactaccatgaccagaagcgcatcacggcccgcaaggacaatatactgcgcctatggagctacctgcaggagctgctgcagtcccggcgccagaggctcgagaccaccctggcactgcagaagctcttccaggacatgctgcacagcatcgactggatggatgagatcaaggctcacctcttgtctgccgagtttgggaagcacttgttggaggttgaagacctgctacagaagcacaagttgatggaagctgacatcgccatccaaggggacaaagtgaaggccatcaccgcagccaccctgaagttcaccgaggggaaagggtaccagccttgtgacccccaggtcatccaggaccgcatcagccacttggagcagtgctttgaggagctgagcaacatggcagctgggcggaaggcccaactggagcagtccaaacgactctggaagttcttctgggagatggatgaggctgagagctggatcaaggagaaggagcagatctattcttccctggactatggcaaagacctgaccagtgtgctcatcttacagcgcaagcacaaggcctttgaggatgagctccgtgggctggatgctcacctggagcagatcttccaggaggctcatggcatggttgcgcgcaagcagtttgggcacccgcagatcgaggcccgcataaaggaggtgtcggcacagtgggaccagctgaaggacctggctgccttctgcaagaagaacctccaggatgctgagaactttttccagttccagggcgatgcggatgacctgaaggcttggctgcaagacgcccaccggctgctctctggtgaagatgtggggcaggacgaaggggccacgcgggccctggggaaaaagcacaaggacttcctggaggagctggaggagagccgtggggtgatggagcacctggagcagcaggcccagggattccccgaagagtttcgggattccccagatgtgacccatcggctgcaggccctgcgggagctctaccaacaggtggtggcccaggcggacctgcgtcagcagaggctgcaggaagccctggacctgtacacggtgttcggggagacagacgcctgtgagctgtggatgggagagaaggagaagtggctggccgagatggaaatgccagacaccctggaggacctggaggtcgtgcagcacaggttcgacatcctggaccaggagatgaagaccttgatgactcagattgatggtgtgaacctcgctgccaacagcttggtagagagtggccacccacgcagcagggaggtgaagcagtaccaggaccatctgaacaccaggtggcaggcatttcagaccctggtgtcggagcggcgggaggctgtggactcagccctccgagtgcacaactactgcgtagattgcgaggagaccagcaagtggatcacggacaagacaaaggtagtggagtccacaaaagacctggggcgggacctggcaggtatcatcgccatccagaggaagttgtcagggctggagcgtgacgtggccgccatccaggcccgtgtggatgccctggagcgtgagtcccagcagctgatggactcgcaccctgagcagaaggaggatattggtcagcggcaaaaacacttggaggagctgtggcagggcctgcagcaatccctgcagggccaggaggacttgctgggggaagtcagccagctgcaggccttcctgcaggatctggatgacttccaggcctggctctccatcacccagaaggctgtggcctctgaggacatgcccgaatccctcccagaggctgagcagctcctgcagcagcatgcaggtatcaaggatgagattgacgggcaccaagacagctaccagcgtgttaaggagtctggggagaaagtgatccaaggccagacggacccagagtatctgcttctgggccagcggctggagggcctggatactggctggaatgccctgggcaggatgtgggagagccgcagccacaccctcgctcagtgccttggcttccaggagttccagaaagatgccaagcaggctgaagccatcctcagcaaccaggaatacactctggctcacttggagcccccagactccctggaagctgcagaggctgggatccggaagtttgaggatttcttggggtctatggagaacaaccgggataaggtcttgagtcctgtggactctggaaacaagctggtagctgagggaaacctatactcagacaagatcaaggagaaggtgcagctgattgaggacaggcacaggaagaacaacgagaaggcccaggaggcctctgtcctactgagagacaacctggagctacagaacttcctccagaactgccaggagctcactctctggatcaacgacaagctgctgacatctcaggatgtctcctatgatgaagcacgaaaccttcacaataaatggctaaagcaccaggcgtttgtggcagagctggcttcccatgaagggtggctagagaacatcgatgcggaaggaaagcagctgatggatgagaagccccagtttacagccctggtgtcccaaaagctggaagccctgcaccggctctgggacgagctgcaggccaccacaaaggagaagacccagcacctctcggctgccaggagctccgacctgcgcttgcagacccatgctgacctcaacaagtggatcagcgccatggaggaccagctgcggtcagacgacccgggcaaggacctgaccagtgtcaatcggatgttggctaagctgaagcgagtggaggaccaagtgaatgtgcgaaaagaggagctgggggagctgtttgcccaggtgccttcaatgggagaggagggaggagatgcagacttgagcatcgagaagcggttcctggacctcctggaacccctaggaaggaggaagaagcagctggaatcatccagagccaagctgcagatcagccgggacttagaggatgagacgctttgggtggaggagaggctgcctctggcccagtcagccgactatggcactaatctgcaaactgtgcaactgttcatgaagaagaaccagacactgcagaatgagattctgggccatacgccgcgggttgaggatgtgctgcagagagggcagcagctggtggaggcggcggagatcgactgccaggaccttgaggagcgcctggggcacctgcagagctcctgggacaggctgcgggaggcagcggccgggaggctgcagcgactgagggacgccaacgaggcacagcagtactacctggatgcagacgaggctgaggcctggattggcgagcaggagctctacgtcatctccgatgagatccccaaggatgaagagggcgccattgtgatgctgaagcgacatttgcggcagcagcgtgcggtggaggactacggccggaacatcaagcagctggccagccgggcccagggcctgctgtctgcaggccaccctgagggggaacagatcatcagacttcaggggcaagtggacaagcactacgcagggctgaaggacgtggcggaagagcgcaagcgcaagctggagaacatgtaccacctgttccagctcaagcgggagaccgacgacctggagcagtggatttcagaaaaggagctagtggcctcttccccggaaatggggcaagactttgaccacgtgactcttctgcgggacaagttccgggactttgcccgggagaccggggcgattgggcaggagcgggtggacaatgtgaatgccttcatcgagcgactcatcgacgcgggccacagcgaggcggccaccatcgccgagtggaaggacgggctgaacgagatgtgggcagacctcctggagctcattgacacgcgcatgcagctgctggccgcctcctatgacctgcaccgctacttctacacgggtgccgagatcctgggcctcatcgacgagaagcaccgcgagctgcccgaggacgtggggctggacgccagcacggccgagtccttccaccgggtgcacacagccttcgagcgggagctccacctgctgggtgtccaggtgcagcagttccaggacgtggccacccgtctgcagacagcatatgctggggagaaggcagaggccatccagaacaaggagcaggaggtgtctgccgcgtggcaggcgctgctcgatgcctgtgccgggcgccggacccagctagtggacacggcggataaattccgcttcttcagcatggcccgtgacctcctctcctggatggagagcatcatccggcagatcgagacccaggagaggcccagggatgtctcctctgtggaactgctcatgaagtatcaccagggcatcaatgcagagattgaaacccggagcaagaacttcagtgcctgcctggagcttggcgagtccctgctgcagcggcagcaccaggcctcagaggagatccgcgagaaactgcagcaggtgatgtccaggaggaaagagatgaatgagaagtgggaagcccgctgggagcggctccgcatgttgctggaggtgtgccagttctcgagggatgcctctgtggctgaggcgtggctgattgcccaggagccctacctggccagcggggactttggacacacagtggacagtgtggagaagctcatcaagaggcatgaggcttttgagaagtccacggccagctgggcagagcgctttgctgccctggagaagcccaccacgcttgagctgaaagaacgccagattgcagagagacccgcagaggagactgggcctcaagaggaggaaggcgagacagcaggggaggctccagtttcccaccatgcggccaccgagagaacgtccccgggggaagaagagggaacgtggcctcagaacctgcagcagccaccaccgccgggtcagcacaaggatgggcagaaatccactggggatgagaggcccaccacggagcccctctttaaggtcctagatacgcctctgagcgagggtgatgagcccgcaacgctgccggccccgcgggaccatgggcagagtgtgcagatggaaggctacctgggccgcaagcatgacctggaggggcccaacaagaaggcttccaacaggtcctggaacaacctgtactgtgtgctcaggaacagtgagctaaccttctacaaggatgccaagaacctggccctggggatgccctaccatggggaggaacccctggccctgagacatgccatctgtgagattgctgccaactacaagaagaagaagcacgtctttaagctgaggctgagtaatggcagcgagtggctcttccatggcaaggatgaggaggagatgctgtcctggctgcagggcgtgagcaccgccatcaacgagtcccagagcatccgcgtcaaggcgcagagcctgcccctgccttccctctccggccccgacgccagcctcggcaagaaagacaaggagaagagattcagcttcttccccaaaaagaagtagcaggtggggctggcgggcgcggcggagtcgggacgcgcagagaccgggcagcccaggccttggcctcctctcgccgccgcccgccggtcgaatcgagatgagtcgagtcgcgggccgggcccccgggccccacgctgcactgcaaaagctgccttcgcccgcgtgtcctgggccgacgccccctccatgccctcgcccgcgctggctccgctccagggacaggggctcccagctcctctggcgcctttggggcctccaggcctgggggcaggaaacggttctctgaggcacacgccctcctctcccaccctcctcctgagccgagggggcacaggccccttacccccaaccaaaaaaaaaaaaaaaaaagagctggagaaggctgatggggttcttcaaacgctgcccgttcctaaagcaagtcttgcttcgggtcacctcccacctggtggcagccagggaaaggggaaaggaagaagacactggaaatgcatggccagccccctaggggcatgaggaaggagccttcaggtggcccacaaagccctagctctgggccaggggctctggggggctgaggggaccagactgggtgcagggccttgggagctgccagcctccttcccactgggcttccgcagaactgggactctcacttcaggggccaccacatccctcctctctgcttctccccccagatcaaagggtaccctcccacggttggcagggcctggctgagtgcctctagcaccctttgtgccaccacaggcggtcccaggaagggcagcaaggtcagaccattcctcattgaaaaccgtggctagggcacagggctctgatctgaaggagtgacaggtgcgtcacaacactgcctaaggctctccctctcaatgctgggaccctcgccccactcccagtggcagccaaaccagcaatatccaacagacataggccccctacgggacagtgtgggcccccagatataagatggataccccccgcacctgcagtaaagcatcccaaagccaaatgctcaattgcatcctgtctgcagctgggactttggagggtaatggctgggcagacagtaaagttgatcatctgttttctcggggtggcagacgcagccatgtcttggtatcaccacccatgtgacagctactcctgcacaactgggacaaatgtcagggccagagccatgaaggtgtggtaccccttgatcagcttctccacgtcctggccccaggtcttggcggggagggggtcacatgagtacagaggtcaaatatctaccaccctccagccctgagcaccagaagctctgcaaccaacgtccccaggaatggccttccccttgctgctcaggtcatacttctggaggaagagaaagctcattccatattttccccaccactctactccgaaagcaacacagttctggcccagtatcaaactagggttaggtccaagagagcagtcaagcgggtcgggggtgggggggagggcggagggcagcaggcattttcccccaaggaaaccatgaaagtccccagggcctgcagtcaagtttctatcaccttccccgtgagaaggaccttagttccatggagatgaagtgggtgaggttcaggtagaagccacaggggcaggcatccagaatgaggccccctgaggaaccctgagtgctgaccagtgccggcagaaatcagttccaccctgtggccctgacactatatgtcagggtgacaccaactgcagcaggcaggagccacaggaaggaagacgtcatccgatggagcctgacatccccaggttcccgccctggtgagcaaggtcttcatttggctttggtacatatgaccctatacagggaacctagtgtgtatcactcaccagcctctttctgtatctggggaaaccaaggcagtgaggtgactgcactcacctagcaataaagtaggcctttggtgcacttgcaggcatgtcctcctctggggcagagagcaggttccttgctgaagggcagatggtggcaaacatctccctcaactgtttccctgggccagtctttagggagcctagggacaagggcccaccctcccccttccacgtgtgccaaatcagcacctgaagtgaggcatttccagcaagcaactccacagacccgagaaaggaagggctctagtggaagagctagcatctcaccaccccaggtcccctggcctggtccagggcagccagctgcatgtgaccattctgttgccagctccccacacatccctcctgtcacccaggctccaagacattcgaccaactagactgaaaatgcaggcatccagctttgggagaccctgtgtgtgccacaccagggctaagctctcccagtgccctagcaaggtctttttttttttttctctccttattctactctacagtcttttgacagtattcccaaacgaggttgacacagctccagtccacaccagcataccaggcttccttcccagggcagtttagaggaagctccttctgggcaaggtcaggcggtcctccttccctctctccttcccctttgtcccagcctcaactgactctggctgtgggaggtgtggagggtccttaggcttccctccccaacctggcctccaccaacacccctaacaggaggcccgtggaaggctcagcctctcctccgcatccctcctccttcctgcctatcggagggagccagggtcccctaggctgaccctgaatcctcttcctcccttcatgggaggggggcaggaatccagaggaggatgaagccagcgggaccacatggcttggtggcttggacaaacaagctcagggaggaaatgaggaggcggcggctgcagaggaatgcaaccctgttgggcacagaccatgcaatctggggctggccctggggccagctgggtcctgtcctccacctgctcaaccgtgcttccaccaaccagaggaaacccatttactagtttttctaataaatcaataatgctcca

SEQ ID NO: 185365 - DNA, 9075 bp, Homo sapiens
  Payload ID: 16501
  Gene Symbol: SPTBN1
  Gene Name: spectrin, beta, non-erythrocytic 1
  Uniprot ID: Q01082
  ENST ID: ENST00000333896
  CDS Start-End: 386-6853
ggtgtgcgcgctgcgcccgcgagctcccgggctcggcaaccgtggcatgcttaggattggccatatttaaaagttctgaagtagaacctgcgcctcctctctgcttctccctcctcctcagtaatttatttcgagcttccaggcaagggccacggaagaagggaaagcaagaaattagatgcctgtgtggtaactcctcgcggagctaaggtggactctcttgcagccaacttcccatcagatcaccctgctggacttgcagaccggaatggggctcgcctaaggagccgagcgctgcggaggctgctgcgtgttggatgggagtgggagggggctggagcgagatttccagggcgcagtcctccggggcgttacgccgggcataatggaattgcagaggacgtctagtatctccgggccgctgtcgccggcgtacacggggcaggtgccttacaactacaaccagctggaaggcagattcaagcagctgcaagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacgggttagttaccgctctcaaacctaccaaaactacaaaaactttaatagcagacggacagccagtgaccagccatggtctggactgtgaagttcactaccatttgtcaagaatcaccctttccaaatcctctgggttttgactttttggcttccacttcacccaaaatgttaaaatttttacttaattcatagccttccttggtttcatatttgtttgcatttaattcatgtttgagtctcttaactgatggatgcccacttgccttaaagcagcatacttattttttgtttatttattgtgagctttttactttattaagattttacagcgaaacccttacatgagtaattgaaatgaaattaaatgagattacagcataatgaagaagaaaactagaatctaacaggtatgacacattcagttattctaacagggcacagtactgtgctatatgtagccgcctttacagatgttattaacctatagtagtttactattaactaggaagactggtgtatgaggagggagacattctgtaataagattaaaacctaaagtcagctgtgtaacattccatgaaagatgcattcatttattgaagatgacaaaaaagggagtcagatatattctggaagctattttaattttaggcacacaatctcatacattttgagacccttgggtcatttattactttttacaaactagttcctctctttttttctgccaagtcctgaattgaaaactgtaggcttccttgcacagatgttgcagccagcctcaggagtaaagtgcccgctgactgctgccgccacctctgtctcgctccctgtcagtgctgctggcacgtgggacgcggcaggtgacagccgttctcagcatgttttagaagcttgcctcacagacttccatgcctctccattcagccgatgacttcagggtgtcaaactgttttaatttttcaaacaaatggaacagaagccattgtggttcatcctgattacttgaacgttgcacttggtggaccgtgcctgggagcgctcgcatgccccctggcttcagaagtcatgtcagtgtctctgtagacaaactccactgtacatcttggattaatcttctgattcattgttcattttctcaagactttttgtggaattctctgataaaggaagcttttaggatggtatctatcaggccaccagcaggaattgaaaatgttttcacaaaaatccttttccttagaaataaaagctggtgacagagatggtttccttgtaccgataaaaacaaaaccaaatccatattatacatcaaaaccttgtgagacattcacttgctcttttgccatatttagatgtgtcagtggaatcagaaacctgttttgatatgtgttctctatgagttaagtctgatttgtctttttatttcatgatgcatgtcttttttttcttttgtcaggataacgtcatatagcatcttgtttgtttttccttatctctatgtacatatctatctacttctgactgtagatgggtatatagatagatgccaagcttcttatgttctgggggtagtatgcatcattattgggtctctgccttaaaacacatcaaaattcattttagacaaaaaaacttctgctttgtctttggtcattagggagctctaatgtgtgtttgtggctccaagttacattttgtgtttcattgatctatatgtatatatgtgatgttttcatatatatatgtgtgtgtgtttaaattttgtatcatcaggactgacacccaatttgacactttttgtatctagaagaccctccaaaaaaggaaccacataagcacacaagaaaagagtgctatgatgttcttagcatttgctatcatgcctatttttatctagatttttaaatgtagcttgtcataacaaaattttaattacaattggcttgtatgagaagaaaaagtatttttattgttttgagtgatgacgcagagactcagtgaacttgaaaatagcattgcttcgtgcactttgaataccaatcaggtgttttctgtgctactagttgtcacgttgcattcatgttcacctcctgatttaagtatctcgggtgtgcccagccactaaagcactctggactaatcgctaaagagaagcaacgtggggggtggggttgcgagggatgtgttcacatgtacccatcatttgatcatagcactgtgattgcttttgatgtgtgtctctagtggtgtgctgtctgttggcatgcttaaagcacatgtccattaaaattcattttgttcctttta

SEQ ID NO: 185366 - DNA, 8482 bp, Homo sapiens
  Payload ID: 16501
  Gene Symbol: SPTBN1
  Gene Name: spectrin, beta, non-erythrocytic 1
  Uniprot ID: Q01082
  ENST ID: ENST00000356805
  CDS Start-End: 282-7376
ggaatcagtgccgctgttgccgtgcaggctgcggattcctccagtccctccctcggccgcctctcctcccggagcgagcgcgcagccctgcgcagcagcgcccactggtcccgtcctgtgagccccggccccagccgcggacagacccgcggagtcgcctcccggcccacccgcccggccgccgaggagcgggaggaggacgggaccccggcgcccccaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacagatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatgtcacgatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatcta

SEQ ID NO: 185367 - DNA, 2164 bp, Homo sapiens
  Payload ID: 16501
  Gene Symbol: SPTBN1
  Gene Name: spectrin, beta, non-erythrocytic 1
  ENST ID: ENST00000389980
  CDS Start-End: 95-2164
cttcaacaggtttgtctcagcgcagggaccctccgggcctgctttggaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgc

SEQ ID NO: 185368 - DNA, 10226 bp, Homo sapiens
  Payload ID: 16501
  Gene Symbol: SPTBN1
  Gene Name: spectrin, beta, non-erythrocytic 1
  ENST ID: ENST00000615901
  CDS Start-End: 250-7350
ggattcctccagtccctccctcggccgcctctcctcccggagcgagcgcgcagccctgcgcagcagcgcccactggtcccgtcctgtgagccccggccccagccgcggacagacccgcggagtcgcctcccggcccacccgcccggccgccgaggagcgggaggaggacgggaccccggcgcccccaccccatccccgggagaactctaagaaggagctgatgtggaggagcagctgagacagttcaagatgacgaccacagtagccacagactatgacaacattgagatccagcagcagtacagtgatgtcaacaaccgctgggatgtcgacgactgggacaatgagaacagctctgcgcggctttttgagcggtcccgcatcaaggctctggcagatgagcgtgaagccgtgcagaagaagaccttcaccaagtgggtcaattcccaccttgcccgtgtgtcctgccggatcacagacctgtacactgaccttcgagatggacggatgctcatcaagctgctggaggtcctctctggagagaggctgcctaaacccaccaagggacgaatgcgcatccactgcttagagaatgtggacaaggcccttcagttcctgaaggagcagagagtccatcttgagaacatggggtcccatgacatcgtggatggaaaccaccggctgacccttggcctcatctggaccatcatcctgcgcttccagatccaggatatcagtgtggaaactgaagacaacaaagagaagaaatctgccaaggatgcattgctgttgtggtgccagatgaagacagctgggtaccccaatgtcaacattcacaatttcaccactagctggagggacggcatggccttcaatgcactgatacacaaacaccggcctgacctgatagattttgacaaactaaagaaatctaacgcacactacaacctgcagaatgcatttaatctggcagaacagcacctcggcctcactaaactgttggaccccgaagacatcagcgtggaccatcctgatgagaagtccataatcacttatgtggtgacttattaccactacttctctaagatgaaggccttagctgttgaaggaaaacgaattggaaaggtgcttgacaatgctattgaaacagaaaaaatgattgaaaagtatgaatcacttgcctctgaccttctggaatggattgaacaaaccatcatcattctgaacaatcgcaaatttgccaattcactggtcggggttcaacagcagcttcaggcattcaacacttaccgcactgtggagaaaccacccaaatttactgagaaggggaacttggaagtgctgctcttcaccattcagagcaagatgagggccaacaaccagaaggtctacatgccccgggaggggaagctcatctctgacatcaacaaggcctgggaaagactggaaaaagcggaacacgaaagagaactggctttgcggaatgagctcataagacaggagaaactggaacagctcgcccgcagatttgatcgcaaggcagctatgagggagacttggctgagcgaaaaccagcgtctggtgtctcaggacaactttgggtttgaccttcctgcagttgaggccgccacaaaaaagcacgaggccattgagacagacattgccgcatacgaggagcgtgtgcaggctgtggtagccgtggccagggagctcgaggccgagaattaccacgacatcaagcgcatcacagcgaggaaggacaatgtcatccggctctgggaatacctactggaactgctcagggcccggagacagcggctcgagatgaacctggggctgcagaagatattccaggaaatgctctacattatggactggatggatgaaatgaaggtgctagtattgtctcaagactatggcaaacacttacttggtgtggaagacctgttacagaagcacaccctggttgaagcagacattggcatccaggcagagcgggtgagaggtgtcaatgcctccgcccagaagttcgcaacagacggggaaggttacaagccctgtgacccccaggtgatccgagaccgcgtggcccacatggagttctgttatcaagagctttgccagctggcggctgagcgcagggcccgtctggaagagtcccgccgcctctggaagttcttctgggagatggcagaagaggaaggctggatacgggagaaggagaagatcctgtcctcggacgattacgggaaagacctgaccagcgtcatgcgcctgctcagcaagcaccgggcgttcgaggacgagatgagcggccgcagtggccactttgagcaggccatcaaggaaggcgaagacatgatcgcggaggagcacttcgggtcggagaagatccgtgagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccagcgccctcccccaggagcatgccgagtctccagacgtgaggggcaggctgtcgggcatcgaggagcggtataaggaggtggcagagctgacgcggctgcggaagcaggcactccaggacactctggccctgtacaagatgttcagcgaggctgatgcctgtgagctctggatcgacgagaaggagcagtggctcaacaacatgcagatcccagagaagctggaggatctggaggtcatccagcacagatttgagagcctagaaccagaaatgaacaaccaggcttcccgggttgcagtggtgaaccagattgcacgccagctgatgcacagcggccacccaagtgagaaggaaatcaaagcccagcaggacaaactcaacacaaggtggagccagttcagagaactggttgacaggaagaaggatgccctcctgtctgccctgagcatccagaactaccacctcgagtgcaatgaaaccaaatcctggattcgggaaaagaccaaggtcatcgagtccacccaggacctgggcaatgacctggctggcgtcatggccctgcagcgcaagctgaccggcatggagcgggacttggtggccattgaggcaaagctgagtgacctgcagaaggaggcggagaagctggagtccgagcaccccgaccaggcccaggccatcctgtctcggctggccgagatcagcgacgtgtgggaggagatgaagaccaccctgaaaaaccgagaggcctccctgggagaggccagcaagctgcagcagttcctacgggacttggacgacttccagtcctggctctctaggacccagacagcgatcgcctcggaggacatgccaaacaccctgaccgaggctgagaagctgctcacgcagcacgagaacatcaagaacgagatcgacaactacgaggaggactaccagaagatgagggacatgggcgagatggtcacccaggggcagaccgatgcccagtacatgtttctgcggcagcggctgcaggccctggacactggatggaacgagctccacaagatgtgggagaacagacaaaatctcctatcccagtcacatgcctaccagcagttcctcagagacacgaagcaagccgaagcctttcttaacaaccaggagtatgttctggctcacactgaaatgcctaccaccttggaaggagctgaagcagcaattaaaaagcaagaggacttcatgaccaccatggacgccaatgaggagaagatcaatgctgtggtggagactggccggaggctggtgagcgatgggaacatcaactcagatcgcatccaggagaaggtggactctattgatgacagacataggaagaatcgtgagacagccagtgaacttttgatgaggttgaaggacaacagggatctacagaaattcctgcaagattgtcaagagctgtctctctggatcaatgagaagatgctcacagcccaggacatgtcttacgatgaagccagaaatctgcacagtaaatggttgaagcatcaagcatttatggcagaacttgcatccaacaaagaatggcttgacaaaatcgagaaggaaggaatgcagctcatttcagaaaagcctgagacggaagctgtggtgaaggagaaactcactggtttacataaaatgtgggaagtccttgaatccactacccagacaaaggcccagcggctctttgatgcaaacaaggccgaacttttcacccagagctgtgcagatctagacaaatggctgcacggcctggagagtcagattcagtctgatgactatggcaaagacctgaccagtgtcaatatcctgctgaaaaagcaacaggcaacaatgctggagaatcagatggaagtgcggaagaaggagatcgaagagctccaaagccaagcccaggccctgagtcaggaagggaagagcaccgacgaggtagacagcaagcgcctcaccgtgcagaccaagttcatggagttgctggagcccttgaacgagaggaagcataacctgctggcctccaaagagatccatcagttcaacagggatgtggaggacgagatcttgtgggttggagagaggatgcctttggcaacttccacggatcatggccacaacctccagactgtgcagctgttaataaagaaaaatcagaccctccagaaagaaatccaggggcaccagcctcgcattgacgacatctttgagaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggccgaagcctggatgagcgagcaggagctgtacatgatgtcagaggagaaggccaaggatgagcagagtgctgtctccatgttgaagaagcaccagatcttagaacaagctgtggaggactatgcagagaccgtgcatcagctctccaagaccagccgggccctggtggccgacagccatcctgaaagtgagcgcattagcatgcggcagtccaaagtggataaactgtacgctggtctgaaagaccttgctgaagagagaagaggcaagctggatgagagacacaggttattccagctcaaccgggaggtggacgacctggagcagtggatcgctgagagggaggtggtcgcagggtcccatgaactgggacaggactatgagcatttcacaatgttacaagaacgattccgggagtttgcccgagacaccgggaacattgggcaggagcgcgtggacacggtcaatcacctggcagatgagctcatcaactctggacattcagatgccgccaccatcgctgaatggaaggatggcctcaatgaagcctgggccgacctcctggagctcattgacacaagaacacagattcttgccgcttcctatgaactgcacaagttttaccacgatgccaaggagatctttgggcgtatacaggacaaacacaagaaactccctgaggagcttgggagagatcagaacacagtggagaccttacagagaatgcacactacatttgagcatgacatccaggctctgggcacacaggtgaggcagctgcaggaggatgcagcccgcctccaggcggcctatgcgggtgacaaggccgacgatatccagaagcgcgagaacgaggtcctggaagcctggaagtccctcctggacgcctgtgagagccgcagggtgcggctggtggacacaggggacaagttccgcttcttcagcatggtgcgcgacctcatgctctggatggaggatgtcatccggcagatcgaggcccaggagaagccaagggatgtatcatctgttgaactcttaatgaataatcatcaaggcatcaaagctgaaattgatgcacgtaatgacagtttcacaacctgcattgaacttgggaaatccctgttggcgagaaaacactatgcatctgaggagatcaaggaaaaattactgcagttgacggaaaagaggaaagaaatgatcgacaagtgggaagaccgatgggaatggttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaagaggaagaggagaggaagaggcggccgccttctcccgagccgagcacgaaggtttcagaggaagccgagtcccagcagcagtgggatacttcaaaaggagaacaagtttcccaaaacggtttgccagctgaacagggatctccacggatggcagaaacggtggacacaagcgaaatggtcaacggcgctacagaacaaaggacgagctctaaagagtccagccccatcccctccccgacctctgatcgtaaagccaagactgccctcccagcccagagtgccgccaccttaccagccagaacccaggagacaccttcggcccagatggaaggcttcctcaatcggaaacacgagtgggaggcccacaataagaaagcctcaagcaggtcctggcacaatgtttattgtgtcataaataaccaagaaatgggtttctacaaagatgcaaagactgctgcttctggaattccctaccacagcgaggtccctgtgagtttgaaagaagctgtctgcgaagtggcccttgattacaaaaagaagaaacacgtattcaagctaagactaaatgatggcaatgagtacctcttccaagccaaagacgatgaggaaatgaacacatggatccaggctatctcttccgccatctcctctgataaacacgaggtgtctgccagcacccagagcacgccagcatccagccgcgcgcagaccctccccaccagcgtcgtcaccatcaccagcgagtccagtcccggcaagcgggaaaaggacaaagagaaagacaaagagaagcggttcagcctttttggcaaaaagaaatgaactcctttccttcacctcctgcccttctcttaccttttcagtgaaattccagcatgcaagctcagaaccaacacattactctctgtgcctaatgttcctcaatgtggttgatttttttttttttttaatttatagagcatttcggggggggtgggggaaacacacctaaacactttatctccaagttacaaaagtttgaggtgcagagggaaggccagattttttttttaatgaaattatatagattagatctcagtatttaaactgttcctcaattttgtgaggctgtgttggaaataacccgcctctagtgctgttggtatgcaaggcagcggtgcttaatcaatatttcctgtgctcaccagaggcaaaatgtaccaatatcctgacaccattctctctccatttacttctggtggttaccctgactcttgactcttagaagtgcccgagatggggctaacctttattaaacagatcgcatattatgatcttgctgcagccacagtgcagctccacattaactctacagaccaaaccatttgtatctggcatcacttactaacacacgacatgcggcttttctgcatcaactgctatgacggttaagaatgtcagtatacaagaaggaatagaaaactgatactgttttaaataatctgtaatttcaattttttttttttgctgaaatacattatattgtacgtttgagataattctagtacaaagtataataaaactagatgtataataaaccctttaaatcattggtaagtgtacaagtggtggaactgaagcatttactggacaaagtaatgttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaacttttgccctatctgttaaatatatgctatgtcattaaatgcttttaaatctagcacggtgactagttgttgttcttcctctgctgcgtgtgcatgcccagtagggaaactgcaaagggagaaatgacaaacaagaaacattttacaaccagtctgggctcacttttgcattttttatgcatgtctggtgcacaagctttgaaaactacagcaaacagtaataaatgtgactgttttgtagttatacattcaggctttatcttttatttatgaaaaagttaccagagcacttgtgaaacctgaactctgagataggggttggcaaatttgttctgtaaagggacagagatagtaaatattttaggctttgtaggccgtaactgtctctgttgctcaattctgctgttgcgtaatacaaaggcagccattgacggtatgtgaatgcctgggcatggctgtgttccagtaaaactatttaaggacataaatttgaatttcatataactttgacatgccatacaatattttgattttcttaatgatttcaaaatgtaaagtctattttatacagatcagaccaaaaagaagaaaaaaaaaaaacaggcaagaggttaggtttggcccatgggccatagtttgctgacttcagcatagagtcgtgggttatttacaagtgacatacttttcctgggttatctgggtatgttgactccatgccacttgcataaagcagcaatggatattagtattatggatgtccagtaagttattccacaaagaccatgcctaaggtggcatcagccctgggctccacagctgcgtggcatcaaagctttctcttaactctcttacctctaggcaaactgagacctcaccatcctctcccctgcttcccacgacagtcctttgcccttgccatgctcagggttggaatcaagttgttctattctcaacagaccaaaatgtttagttaaggcaaagtatcttggaaacaattgtgattaattacagtcttgtactcttgacaaagctgtgcagatggcaataagttcataccagcaatcctggagtcccataataaatacgtacatgtggaacatcgtgcacataatttcaacagttcgcagatctgtagttatgaagccagggtttggtggtatttgctctctcttggtgcatttgataaggatccactgaggcctgaatgtggaagatgatgggcagcgagaggagcgtcagaagaccccagtcaagacgtgttcgccatcagaggttacaggccgcacagcctgatgagcttcaagcctggcagggtaaatagtttttgggttttttgttttttttttattcttccactatcatgttttttgaggattttgcatatttcttgttgccataatgctgtgctattttaccctgattttcagtgatacaatatgggtgacaatactggcccctccataaatctgaagagtaagaagtagtgaaaataaggcttaggatatgaaatggcgttgtcacttgaatcaaggccactttttgtcctacttgagcatctcaagttgggatgcatcttctgatggcacttccggaactggctgtggtttttttgggtgtaccgagagtgccagtgactgtgcttcttacaattcctggcatcttgagtaggtgaaacactgtatcagactgggtgatgggcacattgtcatttcaccaagttcctggaactgttagaattgcttgtgtatggggatcctatgttagttcccctggatacattgttttatcagtcggaattcttaaataaagacatacttcccttc

SEQ ID NO: 185369 - DNA, 7866 bp, Homo sapiens
  Payload ID: 16502
  Gene Symbol: SPTBN2
  Gene Name: spectrin, beta, non-erythrocytic 2
  Uniprot ID: O15020
  ENST ID: ENST00000309996
  CDS Start-End: 73-7245
ccactgagcagccaaccgcagcctctggccacaaggagagcggagcacaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggtggccaagctagagcagagctatgaggcactgtgcgagttggcagcggcgcggcgggcccggctggaggaatcacggcggctctggcgtttcctctgggaggtgggtgaagctgaggcctgggtgcgggagcagcagcacctcctggcctcagccgacacgggccgagacctgaccggtgccctccgcctgctcaacaagcacacagccctgcggggcgagatgagcggccggctggggcccctgaagctcaccctggagcagggccagcagttggtggccgagggtcaccctggggcaagccaggcctctgcccgtgcagctgaactccaagcccagtgggagcggctagaggccctggccgaggagcgtgcccagcggctggcccaagccgccagcctctaccagttccaggccgatgcaaacgacatggaggcctggttggttgacgcactgcgcctggtgtccagccccgagctggggcacgacgagttctccacgcaggctctagccaggcagcatcgggccctggaggaggagattcgaagccaccggccaaccctggacgccttgagggaacaggcagcagccctgccccccacactgagccgcacgcccgaggtgcagagccgggtgcccaccctggagcggcactacgaggagctgcaggcccgggcaggcgagcgagcgcgggccttggaggcagccctggcgctctacaccatgctcagcgaggccggggcctgtggactctgggtggaggagaaggagcagtggctcaacgggctggccctgcctgaacgcctggaggacctggaggtcgtgcagcagaggttcgagaccctggagcctgaaatgaacacccttgcagcacaaatcaccgcggtgaatgacattgccgagcagttactgaaggccaaccccccaggcaaagaccgcattgtcaacacccaggagcagctcaaccacaggtggcagcagtttcggcgtctggcagacggcaagaaggcagctctcacctcagccctgagcatccagaactaccacttagagtgcacggagacccaggcctggatgagagagaagaccaaagtcatcgagtccacccagggcctaggcaacgatctggctggggtgctggccctgcagcgcaagctggccggcacggagcgggacctggaggccatcgccgcccgggtgggcgaactgactcgagaggcaaatgccctggctgccggccatcccgctcaggcagtggccatcaacgcccggctgagagaggtgcagaccggctgggaggacctcagggccaccatgcggcgtcgagaagagtcgctgggggaggcgcggcggctgcaggacttcttgcgcagcttggatgacttccaggcctggctaggccgcactcagactgctgtggcctctgaagaagggccggccaccctgcctgaggcagaggccctcctggcccaacatgcagccctgcggggagaggtggagcgggcccagagcgagtatagccggctgcgagccctgggcgaggaggtgacccgggaccaggctgacccccagtgcctcttcctacgacagcgactggaggccctgggaactggctgggaggagctgggccgaatgtgggagagccggcaaggtcgcctggcccaggcccacggcttccagggattcctgcgggatgctcgtcaggctgagggcgtgctcagcagccaggaatatgttctgtctcacacggagatgccagggacactccaggctgctgatgctgccattaaaaaactggaggacttcatgagcaccatggacgccaatggggaacggatccacgggctcctggaggctggccgccagctggtatctgaaggcaacatccacgccgacaagattcgggaaaaggcagactccattgagaggaggcacaagaagaatcaagacgcagcgcagcaatttctgggccgtcttcgggacaaccgggagcagcagcatttcctgcaagattgtcacgagctgaagctctggatcgacgagaagatgctgacagcccaggacgtgtcctatgacgaggcccgcaacctgcatactaagtggcagaagcaccaggcattcatggccgagctggctgccaacaaagactggctggacaaggtggacaaggaagggcgagagctcacccttgagaagccagagctgaaagccctggtgtcggagaagctgagagacctgcacaggcgctgggacgagctggagaccaccacccaagccaaggcccgcagcctctttgatgccaaccgagctgagctgtttgcccagagctgctgtgccctggagagctggctggagagcctgcaggcccagctgcactcggatgactacggcaaggacctcaccagcgtcaacatcctgctcaagaagcagcagatgctggaatgggagatggctgtgagagagaaggaggtggaggcaatccaggcccaggccaaagcactggcccaggaggaccagggtgcaggggaggtggagagaacctcgagggccgtggaggagaagttcagggccttgtgccagcccatgcgggaacgctgccggcgcctgcaggcttctcgcgagcagcaccagttccaccgcgatgtggaagatgagattttgtgggtgacagagcggctgcccatggccagctccatggagcatggcaaggacctgcccagcgtccagcttctcatgaagaaaaaccagaccctgcagaaagagattcagggccatgagccccggatcgcggacctgagggagcggcagcgtgctctaggtgcagcagcagcaggtccagagctggctgagctgcaggaaatgtggaaacgcctgggccacgagctggaacttcgagggaagcgactggaggatgccctgcgagcccagcagttctaccgcgatgccgccgaggcggaggcctggatgggcgagcaggaattacacatgatgggccaggagaaggccaaggatgagctgagtgcccaggcagaggtgaagaagcaccaggtgctggagcaagccctggccgactacgcgcagaccatccaccagctggcggccagcagccaggacatgattgaccacgagcacccagagagcactcggatatccatccgccaagcccaggtggacaagctgtatgccggcctgaaggagctggctggagagcggcgggagcgcctgcaggagcacctccggctgtgccagctccgccgcgagctggatgacctggaacagtggatccaggagcgcgaggtggtggcggcctcccacgagctgggccaggactacgagcatgtgactatgctccgagacaaattccgagagttctcccgggacacaagcaccatcggtcaggagcgcgtagatagcgccaatgcgctggccaatgggctcattgctgggggccatgctgcacgggccaccgtggccgagtggaaggacagtctcaacgaggcctgggctgacctgcttgagctgctggacacacggggtcaggtgctggccgcggcgtacgagctgcagcgcttcctgcacggggcacgccaagccctggcgcgggtgcagcacaagcagcagcagcttccggacgggactggccgcgacctcaacgctgccgaggccctgcagcgccgacactgtgcctacgagcatgacattcaggccctcagcccccaggtccagcaggtgcaggacgacggccaccggctccagaaggcctacgctggagacaaggctgaggagatcggccgccacatgcaggccgtggccgaggcctgggcccagcttcagggaagctctgccgcccgccggcagctgctgctggacaccacagacaagttccgcttcttcaaggctgtccgggaactgatgctctggatggatgaggtcaacctgcagatggatgcccaggagcgtccccgggatgtgtcctccgcggatctagtcatcaagaaccagcaaggcatcaaggcagagatagaggcccgggcagaccgcttctcctcctgcatcgacatggggaaggagctgctggccaggagccactatgcggccgaggagatctcagagaagctgtctcagctgcaggcacggcgccaggagacagctgagaagtggcaggagaagatggactggcttcagctggttttggaggtgcttgtgtttggaagagatgcagggatggcagaggcctggctctgcagccaggagccactggtgcgcagcgctgagctgggttgcacggtcgacgaagttgagagcctcatcaagcggcacgaggccttccagaagtcagcagtggcctgggaggagcgattctgtgcgctggagaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctctc

SEQ ID NO: 185370 - DNA, 8128 bp, Homo sapiens
  Payload ID: 16502
  Gene Symbol: SPTBN2
  Gene Name: spectrin, beta, non-erythrocytic 2
  Uniprot ID: O15020
  ENST ID: ENST00000533211
  CDS Start-End: 333-7505
gatgttctgggagggagagccggcccagctgcctgaaggaggacgcgagagcgaggggacgggtgagaggaatgcttagcggagacggactggaggtgcccggagaggaaaggggaacggaggctggatctcgggaaacctcgtcggcagtgtcattagaggaaggatcgcgtgtctcggggatacggattttggaggaaaagcagaatagggacaaaggcttcccaggtggcttcccctcttcccctgggggctgatttccactgagcagccaaccgcagcctctggccacaaggagagcggagcacaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggtggccaagctagagcagagctatgaggcactgtgcgagttggcagcggcgcggcgggcccggctggaggaatcacggcggctctggcgtttcctctgggaggtgggtgaagctgaggcctgggtgcgggagcagcagcacctcctggcctcagccgacacgggccgagacctgaccggtgccctccgcctgctcaacaagcacacagccctgcggggcgagatgagcggccggctggggcccctgaagctcaccctggagcagggccagcagttggtggccgagggtcaccctggggcaagccaggcctctgcccgtgcagctgaactccaagcccagtgggagcggctagaggccctggccgaggagcgtgcccagcggctggcccaagccgccagcctctaccagttccaggccgatgcaaacgacatggaggcctggttggttgacgcactgcgcctggtgtccagccccgagctggggcacgacgagttctccacgcaggctctagccaggcagcatcgggccctggaggaggagattcgaagccaccggccaaccctggacgccttgagggaacaggcagcagccctgccccccacactgagccgcacgcccgaggtgcagagccgggtgcccaccctggagcggcactacgaggagctgcaggcccgggcaggcgagcgagcgcgggccttggaggcagccctggcgctctacaccatgctcagcgaggccggggcctgtggactctgggtggaggagaaggagcagtggctcaacgggctggccctgcctgaacgcctggaggacctggaggtcgtgcagcagaggttcgagaccctggagcctgaaatgaacacccttgcagcacaaatcaccgcggtgaatgacattgccgagcagttactgaaggccaaccccccaggcaaagaccgcattgtcaacacccaggagcagctcaaccacaggtggcagcagtttcggcgtctggcagacggcaagaaggcagctctcacctcagccctgagcatccagaactaccacttagagtgcacggagacccaggcctggatgagagagaagaccaaagtcatcgagtccacccagggcctaggcaacgatctggctggggtgctggccctgcagcgcaagctggccggcacggagcgggacctggaggccatcgccgcccgggtgggcgaactgactcgagaggcaaatgccctggctgccggccatcccgctcaggcagtggccatcaacgcccggctgagagaggtgcagaccggctgggaggacctcagggccaccatgcggcgtcgagaagagtcgctgggggaggcgcggcggctgcaggacttcttgcgcagcttggatgacttccaggcctggctaggccgcactcagactgctgtggcctctgaagaagggccggccaccctgcctgaggcagaggccctcctggcccaacatgcagccctgcggggagaggtggagcgggcccagagcgagtatagccggctgcgagccctgggcgaggaggtgacccgggaccaggctgacccccagtgcctcttcctacgacagcgactggaggccctgggaactggctgggaggagctgggccgaatgtgggagagccggcaaggtcgcctggcccaggcccacggcttccagggattcctgcgggatgctcgtcaggctgagggcgtgctcagcagccaggaatatgttctgtctcacacggagatgccagggacactccaggctgctgatgctgccattaaaaaactggaggacttcatgagcaccatggacgccaatggggaacggatccacgggctcctggaggctggccgccagctggtatctgaaggcaacatccacgccgacaagattcgggaaaaggcagactccattgagaggaggcacaagaagaatcaagacgcagcgcagcaatttctgggccgtcttcgggacaaccgggagcagcagcatttcctgcaagattgtcacgagctgaagctctggatcgacgagaagatgctgacagcccaggacgtgtcctatgacgaggcccgcaacctgcatactaagtggcagaagcaccaggcattcatggccgagctggctgccaacaaagactggctggacaaggtggacaaggaagggcgagagctcacccttgagaagccagagctgaaagccctggtgtcggagaagctgagagacctgcacaggcgctgggacgagctggagaccaccacccaagccaaggcccgcagcctctttgatgccaaccgagctgagctgtttgcccagagctgctgtgccctggagagctggctggagagcctgcaggcccagctgcactcggatgactacggcaaggacctcaccagcgtcaacatcctgctcaagaagcagcagatgctggaatgggagatggctgtgagagagaaggaggtggaggcaatccaggcccaggccaaagcactggcccaggaggaccagggtgcaggggaggtggagagaacctcgagggccgtggaggagaagttcagggccttgtgccagcccatgcgggaacgctgccggcgcctgcaggcttctcgcgagcagcaccagttccaccgcgatgtggaagatgagattttgtgggtgacagagcggctgcccatggccagctccatggagcatggcaaggacctgcccagcgtccagcttctcatgaagaaaaaccagaccctgcagaaagagattcagggccatgagccccggatcgcggacctgagggagcggcagcgtgctctaggtgcagcagcagcaggtccagagctggctgagctgcaggaaatgtggaaacgcctgggccacgagctggaacttcgagggaagcgactggaggatgccctgcgagcccagcagttctaccgcgatgccgccgaggcggaggcctggatgggcgagcaggaattacacatgatgggccaggagaaggccaaggatgagctgagtgcccaggcagaggtgaagaagcaccaggtgctggagcaagccctggccgactacgcgcagaccatccaccagctggcggccagcagccaggacatgattgaccacgagcacccagagagcactcggatatccatccgccaagcccaggtggacaagctgtatgccggcctgaaggagctggctggagagcggcgggagcgcctgcaggagcacctccggctgtgccagctccgccgcgagctggatgacctggaacagtggatccaggagcgcgaggtggtggcggcctcccacgagctgggccaggactacgagcatgtgactatgctccgagacaaattccgagagttctcccgggacacaagcaccatcggtcaggagcgcgtagatagcgccaatgcgctggccaatgggctcattgctgggggccatgctgcacgggccaccgtggccgagtggaaggacagtctcaacgaggcctgggctgacctgcttgagctgctggacacacggggtcaggtgctggccgcggcgtacgagctgcagcgcttcctgcacggggcacgccaagccctggcgcgggtgcagcacaagcagcagcagcttccggacgggactggccgcgacctcaacgctgccgaggccctgcagcgccgacactgtgcctacgagcatgacattcaggccctcagcccccaggtccagcaggtgcaggacgacggccaccggctccagaaggcctacgctggagacaaggctgaggagatcggccgccacatgcaggccgtggccgaggcctgggcccagcttcagggaagctctgccgcccgccggcagctgctgctggacaccacagacaagttccgcttcttcaaggctgtccgggaactgatgctctggatggatgaggtcaacctgcagatggatgcccaggagcgtccccgggatgtgtcctccgcggatctagtcatcaagaaccagcaaggcatcaaggcagagatagaggcccgggcagaccgcttctcctcctgcatcgacatggggaaggagctgctggccaggagccactatgcggccgaggagatctcagagaagctgtctcagctgcaggcacggcgccaggagacagctgagaagtggcaggagaagatggactggcttcagctggttttggaggtgcttgtgtttggaagagatgcagggatggcagaggcctggctctgcagccaggagccactggtgcgcagcgctgagctgggttgcacggtcgacgaagttgagagcctcatcaagcggcacgaggccttccagaagtcagcagtggcctgggaggagcgattctgtgcgctggagaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctctcac

SEQ ID NO: 185371 - DNA, 8085 bp, Homo sapiens
  Payload ID: 16502
  Gene Symbol: SPTBN2
  Gene Name: spectrin, beta, non-erythrocytic 2
  Uniprot ID: O15020
  ENST ID: ENST00000529997
  CDS Start-End: 1-7098
atgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggtggccaagctagagcagagctatgaggcactgtgcgagttggcagcggcgcggcgggcccggctggaggaatcacggcggctctggcgtttcctctgggaggtgggtgaagctgaggcctgggtgcgggagcagcagcacctcctggcctcagccgacacgggccgagacctgaccggtgccctccgcctgctcaacaagcacacagccctgcggggcgagatgagcggccggctggggcccctgaagctcaccctggagcagggccagcagttggtggccgagggtcaccctggggcaagccaggcctctgcccgtgcagctgaactccaagcccagtgggagcggctagaggccctggccgaggagcgtgcccagcggctggcccaagccgccagcctctaccagttccaggccgatgcaaacgacatggaggcctggttggttgacgcactgcgcctggtgtccagccccgagctggggcacgacgagttctccacgcaggctctagccaggcagcatcgggccctggaggaggagattcgaagccaccggccaaccctggacgccttgagggaacaggcagcagccctgccccccacactgagccgcacgcccgaggtgcagagccgggtgcccaccctggagcggcactacgaggagctgcaggcccgggcaggcgagcgagcgcgggccttggaggcagccctggcgctctacaccatgctcagcgaggccggggcctgtggactctgggtggaggagaaggagcagtggctcaacgggctggccctgcctgaacgcctggaggacctggaggtcgtgcagcagaggttcgagaccctggagcctgaaatgaacacccttgcagcacaaatcaccgcggtgaatgacattgccgagcagttactgaaggccaaccccccaggcaaagaccgcattgtcaacacccaggagcagctcaaccacaggtggcagcagtttcggcgtctggcagacggcaagaaggcagctctcacctcagccctgagcatccagaactaccacttagagtgcacggagacccaggcctggatgagagagaagaccaaagtcatcgagtccacccagggcctaggcaacgatctggctggggtgctggccctgcagcgcaagctggccggcacggagcgggacctggaggccatcgccgcccgggtgggcgaactgactcgagaggcaaatgccctggctgccggccatcccgctcaggcagtggccatcaacgcccggctgagagaggtgcagaccggctgggaggacctcagggccaccatgcggcgtcgagaagagtcgctgggggaggcgcggcggctgcaggacttcttgcgcagcttggatgacttccaggcctggctaggccgcactcagactgctgtggcctctgaagaagggccggccaccctgcctgaggcagaggccctcctggcccaacatgcagccctgcggggagaggtggagcgggcccagagcgagtatagccggctgcgagccctgggcgaggaggtgacccgggaccaggctgacccccagtgcctcttcctacgacagcgactggaggccctgggaactggctgggaggagctgggccgaatgtgggagagccggcaaggtcgcctggcccaggcccacggcttccagggattcctgcgggatgctcgtcaggctgagggcgtgctcagcagccaggaatatgttctgtctcacacggagatgccagggacactccaggctgctgatgctgccattaaaaaactggaggacttcatgagcaccatggacgccaatggggaacggatccacgggctcctggaggctggccgccagctggtatctgaaggcaacatccacgccgacaagattcgggaaaaggcagactccattgagaggaggcacaagaagaatcaagacgcagcgcagcaatttctgggccgtcttcgggacaaccgggagcagcagcatttcctgcaagattgtcacgagctgaagctctggatcgacgagaagatgctgacagcccaggacgtgtcctatgacgaggcccgcaacctgcatactaagtggcagaagcaccaggcattcatggccgagctggctgccaacaaagactggctggacaaggtggacaaggaagggcgagagctcacccttgagaagccagagctgaaagccctggtgtcggagaagctgagagacctgcacaggcgctgggacgagctggagaccaccacccaagccaaggcccgcagcctctttgatgccaaccgagctgagctgtttgcccagagctgctgtgccctggagagctggctggagagcctgcaggcccagctgcactcggatgactacggcaaggacctcaccagcgtcaacatcctgctcaagaagcagcagatgctggaatgggagatggctgtgagagagaaggaggtggaggcaatccaggcccaggccaaagcactggcccaggaggaccagggtgcaggggaggtggagagaacctcgagggccgtggaggagaagttcagggccttgtgccagcccatgcgggaacgctgccggcgcctgcaggcttctcgcgagcagcaccagttccaccgcgatgtggaagatgagattttgtgggtgacagagcggctgcccatggccagctccatggagcatggcaaggacctgcccagcgtccagcttctcatgaagaaaaaccagaccctgcagaaagagattcagggccatgagccccggatcgcggacctgagggagcggcagcgtgctctaggtgcagcagcagcaggtccagagctggctgagctgcaggaaatgtggaaacgcctgggccacgagctggaacttcgagggaagcgactggaggatgccctgcgagcccagcagttctaccgcgatgccgccgaggcggaggcctggatgggcgagcaggaattacacatgatgggccaggagaaggccaaggatgagctgagtgcccaggcagaggtgaagaagcaccaggtgctggagcaagccctggccgactacgcgcagaccatccaccagctggcggccagcagccaggacatgattgaccacgagcacccagagagcactcggatatccatccgccaagcccaggtggacaagctgtatgccggcctgaaggagctggctggagagcggcgggagcgcctgcaggagcacctccggctgtgccagctccgccgcgagctggatgacctggaacagtggatccaggagcgcgaggtggtggcggcctcccacgagctgggccaggactacgagcatgtgactatgctccgagacaaattccgagagttctcccgggacacaagcaccatcggtcaggagcgcgtagatagcgccaatgcgctggccaatgggctcattgctgggggccatgctgcacgggccaccgtggccgagtggaaggacagtctcaacgaggcctgggctgacctgcttgagctgctggacacacggggtcaggtgctggccgcggcgtacgagctgcagcgcttcctgcacggggcacgccaagccctggcgcgggtgcagcacaagcagcagcagcttccggacgggactggccgcgacctcaacgctgccgaggccctgcagcgccgacactgtgcctacgagcatgacattcaggccctcagcccccaggtccagcaggtgcaggacgacggccaccggctccagaaggcctacgctggagacaaggctgaggagatcggccgccacatgcaggccgtggccgaggcctgggcccagcttcagggaagctctgccgcccgccggcagctgctgctggacaccacagacaagttccgcttcttcaaggctgtccgggaactgatgctctggatggatgaggtcaacctgcagatggatgcccaggagcgtccccgggatgtgtcctccgcggatctagtcatcaagaaccagcaaggcatcaaggcagagatagaggcccgggcagaccgcttctcctcctgcatcgacatggggaaggagctgctggccaggagccactatgcggccgaggagatctcagagaagctgtctcagctgcaggcacggcgccaggagacagctgagaagtggcaggagaagatggactggcttcagctggttttggaggtgcttgtgtttggaagagatgcagggatggcagaggcctggctctgcagccaggagccactggtgcgcagcgctgagctgggttgcacggtcgacgaagttgagagcctcatcaagcggcacgaggccttccagaagtcagcagtggcctgggaggagcgattctgtgcgctggagaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggtgagctgtccttcgtgttcctctctgtccgtgccattccagaagcttccagctgcagactccccttctttccctgtcctccctctttttcctggtcttgtcctttgtggtaagactggatgtgtgcgacggccgcaccaggccgcactccctgtctaagccggccacattctcctaatagcatgaaacagtcagctcactttctgcctcctcctcttacacttccctgctgtccactgcggccaactcagcacagtgtccttgaagctgattgagggtctttccatccacaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctc

SEQ ID NO: 185372 - DNA, 859 bp, Homo sapiens
  Payload ID: 16502
  Gene Symbol: SPTBN2
  Gene Name: spectrin, beta, non-erythrocytic 2
  ENST ID: ENST00000527010
  CDS Start-End: 509-859
tgatttgggcataattccttcctctcctaagcaggcagcagttcaccttggttaaggaccttggaccttagaccactcagacgctaacaaaccaaggagaaacccagccgtgtcaggcctagaaatgtctgcccccacccccacccccctcaagacggtgactaggccggaattctcctggttgataaatgagaggagctgagaagcgctgagatgcctgtttggagcatctgatctgtagaagacgaatcttcactgtgccatggagatgttctgggagggagagccggcccagctgcctgaaggaggacgcgagagcgaggggacgggtgagaggaatgcttagcggagacggactggaggtgcccggagaggaaaggggaacggaggctggatctcgggaaacctcgtcggcagtgtcattagaggaaggatcgcgtgtctcggggatacggattttggaggaaaagcagaatagggacaaaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggag

SEQ ID NO: 185373 - DNA, 2890 bp, Homo sapiens
  Payload ID: 16502
  Gene Symbol: SPTBN2
  Gene Name: spectrin, beta, non-erythrocytic 2
  ENST ID: ENST00000611817
  CDS Start-End: 44-2848
cacaaggagagcggagcacaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggtggccaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcagg

SEQ ID NO: 185374 - DNA, 3498 bp, Homo sapiens
  Payload ID: 16502
  Gene Symbol: SPTBN2
  Gene Name: spectrin, beta, non-erythrocytic 2
  ENST ID: ENST00000617502
  CDS Start-End: 73-2877
ccactgagcagccaaccgcagcctctggccacaaggagagcggagcacaggagcaggaagccgcctaccaccatgagcagcacgctgtcacccacagactttgacagcttggaaatccagggccagtacagtgacatcaacaaccgctgggaccttcctgactcggactgggacaatgacagcagctcggcccgcctctttgagaggtctcgcattaaggctctggcagatgaacgagaagctgtgcagaagaaaaccttcaccaagtgggtaaactcgcacctggcccgggtcacgtgccgggtgggggacctgtacagcgacctccgggacggacgcaacctgctgaggctcctcgaggtgctctcgggagagatactgccaaagcctacaaagggccgcatgcggatccactgcctggagaacgtggacaaggcactgcagttcctcaaggagcagaaagtgcacttggaaaacatgggctcccatgacattgtggacggaaaccaccgactgacccttgggctggtctggaccatcatccttcgattccagatccaagacatcagtgtggagacagaagacaacaaggagaagaagtcagccaaggatgccctgcttctgtggtgccagatgaagactgcaggttatcccaacgtcaatgtacacaacttcaccaccagctggagagatggactagctttcaacgccatcgtgcataaacaccggccagacctgctggattttgagtctctgaagaagtgtaatgcacactataatctgcagaatgcattcaatctggctgaaaaggaactgggacttaccaagctgctggatcccgaagacgtgaatgtggaccagccagatgagaagtcaatcattacctatgtggctacttactaccattacttctccaagatgaaggccctggccgtggaaggcaagagaattggcaaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtttaccgagaaagggaacttggaagtgctgctcttcaccatccagagcaagcttcgggccaacaaccagaaggtctacacgccccgcgagggccggctcatctcggacatcaacaaggcttgggagcggctggagaaggcggagcacgagcgtgagctggccctgcgcaccgagctcatccgccaggagaagctggagcagctggccgcccgcttcgaccgcaaggctgccatgcgggagacctggctcagcgagaaccagcgcctcgtgtcccaggacaactttgggctggagctggcagctgtcgaggcagcagtacggaagcacgaagccattgagacggacatcgtggcctacagcggccgggtgcaggcagtggacgccgtggctgcagagctggccgccgagcgctaccacgacatcaagcgcatcgccgctcggcagcacaacgtggcacggctctgggacttcttgcggcagatggtggccgcccggcgggagcggctcctcctcaacctggagctgcagaaggtgttccaggacctgctctacctcatggactggatggaagagatgaagggccggctgcagtctcaggacctgggcaggcacctagcaggagtggaggacctgctgcagctgcacgagctggtggaggcagacatcgccgtgcaggccgagagggtgcgggccgtcagcgcctctgccctgcgcttctgcaacccagggaaagagtatagaccttgcgacccgcagctggtgtcggagcgggttgcaaagcttactgcgctagaggagcgggagaaggagcgaaagagaaagagggaggaggaggagcggcggaaacagccgcctgctcccgaacccacagccagtgtgcctccaggggacctggtgggcggccagacagcttctgacaccacctgggacggaacccagccacggccaccaccatccacacaagcacccagtgttaatggagtctgcacagatggagagccctcacagcccctgctgggacaacagagacttgagcacagcagcttccccgaagggccgggacctggctcaggggacgaagccaatgggccccggggagagaggcagacccggactcggggcccggccccatctgcaatgccccagagcaggtctaccgagtcagcccatgctgccaccctgccgcctcgaggcccagagccatctgcccaggagcagatggaggggatgctgtgccgcaagcaggagatggaggccttcgggaagaaggctgccaacaggtcctggcagaacgtgtactgtgtcctgcggcgtgggagcctcggcttttacaaggatgccaaggcagccagcgcgggagtgccataccacggagaagtgcctgtcagcctggccagggcccagggcagcgtcgcctttgattaccgaaagcgcaaacatgtcttcaagctgggcttacaggatggaaaagaatatttattccaggccaaggatgaggcagagatgagctcgtggctacgggtggtgaatgcagccattgccacagcgtcttctgcctctggagagcctgaagagccggtggtgcccagcaccacccggggcatgacccgggccatgaccatgcccccagtgtcacccgtcggggctgaggggcctgttgtgctccgcagcaaagacggcagagaacgagagcgagaaaaacgcttcagcttctttaagaagaacaagtagttgggggcaaggtcccaggccaactccctccctccgttcaggaaactgccagggacagtcgacagggaccgccctcttgtcaggacaactgcctgctgctagggtctgttgccaaggtcaacccatcaccaggaactgtcactggggacgagtccatgttcccaagggcagcccttctcttctgctgtttaattccagactggtggtgggacccaggtaaccccctctcccacccccgccgacttctcccctttccccagcctcgtgcctctgtccctcaccacggtgtggacagtgccgcaccctcaacataggccatgtggggagtggctgcccctgcctcagggtcattctcctgccatgcgagggcactcgccttctgccttctggttcctcacccctcagaccagccaggaacctctcagagctgaagcaggccctgggggcagaagtgccagatgacagtcagaggcgcaggagccctccctccccacccccaccctgtaactccagctgccactccatctccagctgctctcaatggcttccaggtgtgttgttcggggacagccaccgccttgagtctggccaaggaggtgattaaacagctcagcttctctc

SEQ ID NO: 185375 - DNA, 8676 bp, Homo sapiens
  Payload ID: 16503
  Gene Symbol: SPTBN4
  Gene Name: spectrin, beta, non-erythrocytic 4
  Uniprot ID: Q9H254
  ENST ID: ENST00000352632
  CDS Start-End: 87-7781
tatgaccctgtgtgactcagtgacccggagggcaagcaggactgtgggtgacaccttgtgtcatcctctgagcctcaccttccccgatggcgcaggtaccaggggaagtggacaacatggagggcctgcctgctcctaacaacaaccctgctgcccgctgggagagtccggatcggggctgggagcgggagcagccggctgcgtccaccgcagcggcctcgctctttgagtgctcccggatcaaggccttggcagatgagcgggaagccgtgcagaagaaaaccttcaccaagtgggtgaactcgcacctcgcccgcgtgggctgccacatcggggacctctatgtggacctccgggacggcttcgtgctcacgcggctcctggaagtgctgtctggggagcagctgcccaggcccacgcgcggccgcatgcggatccactcactggagaacgtggacaaggcgctgcagtttctgaaggagcagcgcgtgcacctggagaacgtgggttcgcatgacatcgtggatgggaatcaccggctgacgctggggctggtctggaccatcatcctgcgcttccagattcaagtcatcaaaattgagactgaggacaacagagagacacgctcagccaaggatgctctgctcttgtggtgtcagatgaagacagctggttaccctgaggtaaacatccagaatttcaccaccagctggcgggatggcttggccttcaatgccctcattcaccggcacaggcctgatctcgtggacttcagcaaactcaccaagtccaatgccaactacaacctgcagagagccttccgcacagctgagcagcacctggggctggcgcggctgctggatcctgaagatgtgaacatggaggctccagatgagaagtccatcatcacctacgtggtctctttctaccactatttctccaagatgaaggctctggctgtggaggggaagcgtatcgggaaggtcttggaccaggtattggaggtggggaagatcatagaacgctacgaggagctggcggctgagctgctggcctggatccaccgcaccgtgggcctcatcagcaatcagaaatttgccaactccttaagtggggtgcagcagcaactccaggctttcacggcctattgcacgctggagaagcctgtcaagttccaggagaaggggaacctagaggtgctgctcttcagcatccagagcaaactgcgtgcctgcaaccgtcgcctctttgtgcctcgggagggctgtggcatctgggatattgacaaggcatggggtgagctggagaaggctgagcatgagcgggaggctgccctacgggctgagctgattcggcaggagaagctggaactactggcacagaggtttgaccacaaggtggctatgagggagagctggctgaatgagaaccagcgtctggtctcccaggacaactttgggtatgagctgcccgcagtggaggcagccatgaagaaacacgaagcgatcgaggcagacattgcggcctacgaggagcgggtgcagggtgtggcggagctggcccaggcattggcagccgaaggctactacgatatccggcgggtggcagcccagcgtgacagcgtcctgcgccagtgggccctgctaactgggcttgtgggtgcccggcggacacgacttgagcagaaccttgccctgcagaaggtcttccaggagatggtgtacatggtggactggatggaggagatgcaggctcagctgctgtcccgggagtgtgggcagcacctggtggaggcagacgacctgttgcagaagcatggactgctggagggagacattgccgcccagagcgagcgggtggaggctctcaatgccgctgccctgcgcttctcccagctgcagggctaccagccctgcgacccgcaggtcatctgcaaccgcgtgaaccacgtgcacggctgcctggcggagctgcaggagcaggcagcgcggcgacgcgcggagctggaggcttcgcggagcctgtgggcgctgctgcaggagctggaggaggccgagagctgggcgcgcgacaaggagcgtctcctggaggctgcgggcggcggcggtgcggcgggcgcagcgggcgcagcgggaacagcgggcggcgcgcatgacctgtccagcacagcgcgcctcctggcccagcacaagatcctgcagggcgagctgggcgggcggcgagcgttgctgcagcaggccctgcggtgtggcgaggagctggttgcggccggcggtgccgtcggcccgggagcagacaccgtgcacctggtaggcctggcggagcgcgcggcgagcgcccggcgccgctggcagaggctggaagaggcggcggcgcggcgagagcggcggctgcaggaggcgcgggcgctgcaccagttcggcgctgacctcgacgggctgctggactggcttcgcgacgcttaccgcctggcagccgccggtgacttcggccacgacgaagcttccagccgccgcctggcgcgccagcaccgcgcgctcaccggggaggtggaggcacatcgcgggcccgtgagcggcctgcggcgccagctggcgacactcgggggtgccagtggcgcagggccactggtggtggcgctgcaggtgcgcgtggtggaagcagagcagttgttcgctgaggtgaccgaagtggcggcgctgaggcgccagtggctgcgggacgcgctcgctgtctaccgcatgtttggcgaggtgcacgcgtgtgagctgtggatcggcgagaaggagcaatggctgctctccatgcgtgtgccggattcactcgacgacgtcgaggtggtgcagcaccgattcgagagcctggaccaagagatgaacagcctgatgggccgcgttctggacgtgaaccacacagtccaggagctggtggaaggaggccaccccagttcagatgaggtgcgttcctgccaggaccacctcaacagcaggtggaaccgcatcgtggagctagtggaacagcgcaaagaggaaatgagcgcggtgctgctggtggagaaccacgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggcccgggcctggcactagacgagtggctgccacacctcgaacttggctggcataaactgctcggcttgtgggaggcgcgcagggaggcgctggtccaggcgcacatctaccagctcttcctgcgggatctacgccaggcgctcgtggtgctgcgtaaccaggagatggcgctgtctggtgcggagctcccgggcacagtggaatcggtggaggaggccttgaaacagcaccgtgactttctcaccaccatggagctgagccagcaaaagatgcaggtggccgtgcaggctgcagagggcctgctgaggcagggcaacatctacggggagcaggctcaggaggctgtgacccggctgctggagaagaaccaagaaaaccagttacgggcccagcaatggatgcaaaagctacatgaccaacttgagctgcagcacttcctccgagactgccacgagctggatggctggatccatgagaagatgctgatggcgcgggatggcacgcgggaggacaaccacaagctgcataagagatggctccggcaccaggcattcatggccgagctggctcagaataaggagtggctggagaagatcgagcgggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcagtccatggagtcgcaggtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgacctggacgacgagctggcatgggttcaggagcggctgccactggccatgcagacagagcgaggcaacggtttgcaggcggtccagcagcacatcaaaaagaaccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggacgaacagagcaccctgcagctgctcaagaaacacctgcagctggagcaaggcgtggagaactacgaggaaagcatcgcgcagctgtcgcgccagtgccgggcgctgctggagatggggcacccggacagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccagggacgtgtcatcagtggaggtgctcatgaactaccaccagggcctgaagactgagctggaggcgcgggtgcctgagctgaccacctgccaggagctggggcgatctctgctgctcaacaaaagtgccatggctgatgagatccaggcacagctggacaagctgggaaccaggaaggaggaggtgtcggaaaagtgggaccgccattgggagtggctgcagcagatgctggaggtgcaccagtttgcccaggaggcggtggtggctgatgcctggctgacagcccaggagccgctcctgcagagccgggagctgggcagcagcgtggatgaggtggagcagcttatccggcgacatgaggccttccgcaaagcggctgcagcctgggaagagaggttcagctctctgcggcgcctgaccacgatcgagaaaatcaaagcggaacagagcaagcagccgcctaccccactgctggggcgcaagttctttggggaccccacggaactggcggccaaggcggcgcccctgctgcggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggccgcaccagaggacgcggcggagacccccgcgacccccgcggcggcggagcaggtgcggccacgaccggagcgccaggagtcagctgatcgcgcggaggagctgcccaggaggcggcggcctgagcggcaagagtcagtcgatcaatccgaggaggctgcgcggaggcggcggccggagcggcaggagtcagcggagcacgaggcggcacacagccttaccctgggccgctatgagcagatggagcggcggcgcgagcggcgtgagcggcgcttggagcggcaggagtccagcgaacaggagatgcccatcagaggagacctggtcaaggggaaggccaccctggctgacattgtggaacagctgcaggagaaagaggcaggcccagggctgcctgctgggccgtcgctgcctcagccacgcgagcttcccccaggtcgcctgcccaacgggcttgagctgcccgagcggacacctcggccggaccggccccgggcgcgggaccggcccaagccgcgacggcggccgcggcccagagagggtggtgagggcgggggaagccggcgctcgcgctccgccccggcccagggcggctccgcccccgcgcctccgccaccgcccactcacacagtgcagcacgagggcttcctactgcgcaagcgcgagctcgacgctaaccgcaagtcgtccaaccggtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtgactacaagaaaaagaagcatgtcttcaagctccagacccaggatggcagtgagtttttgctccaggcaaaagatgaggaggagatgaacggctggctggaggctgtagcttcctcggtggcggaacacgcagagatcgcccgctggggccagacactacccactacttcatccacagatgagggcaaccctaagagggaaggcggagatcgcagggccagcgggcgcaggaagtgacttcccacccccaggacctgacacatctcgtctcccctcttttccgcactgtgggcacaaagacactttttcttccgcaggggcgggagcccctagttccaacactgaggacgcgtgacatggtgggcaccggaaaggaggggacttctcctgcaccccaagaagtggtggggagattgctgcccctatagccatatctcggccccttcccactcaccacccccaccccaggtgctgggggtcccttatttttatgcaataactgagcttgatgggggtgggcagggggccagttgagccaagcccccagccccgatctgcagatcctgccccaagaagctggggtggtgggggcagtaattcctgcccccctctctgccctagggatgggcacgggggcgctggtgaggtcccctggaccatccagggtgctagggggcagggaggggacaccccctccccgcctttacctcacttccaatgctgccttgatctctgtctgggaggggggagtgaaggggccctagccccctgcactccgccgcctcagagccatgcggttaattcctgacttagtttatttttgcaaaacgtcgatctcctcctcccccgccccgcatccgcgaaggcttttaatgggaggggcgtcaaagctcaaaactgttttcctctctcctcccccctccagttgtaaatgccacttcatgaggggaggggcgaggggaagcccacccctgcatgcttctggctggagcacctccctggggagtcgggggattgggttgtgggcagtccccatggccgcctggagaagccgctggggcccgggggtgtggggcggtgtggcgggcgcacactgtatgtacctataataaaccctttggctttgacggtc

SEQ ID NO: 185376 - DNA, 8686 bp, Homo sapiens
  Payload ID: 16503
  Gene Symbol: SPTBN4
  Gene Name: spectrin, beta, non-erythrocytic 4
  ENST ID: ENST00000338932
  CDS Start-End: 103-7797
ggccgggccgggcagcggacgccgacagggagggcggtcggtcgcggcgagcagcggagacagcgacgctggcggccgcgggcccaggcctcaccttccccgatggcgcaggtaccaggggaagtggacaacatggagggcctgcctgctcctaacaacaaccctgctgcccgctgggagagtccggatcggggctgggagcgggagcagccggctgcgtccaccgcagcggcctcgctctttgagtgctcccggatcaaggccttggcagatgagcgggaagccgtgcagaagaaaaccttcaccaagtgggtgaactcgcacctcgcccgcgtgggctgccacatcggggacctctatgtggacctccgggacggcttcgtgctcacgcggctcctggaagtgctgtctggggagcagctgcccaggcccacgcgcggccgcatgcggatccactcactggagaacgtggacaaggcgctgcagtttctgaaggagcagcgcgtgcacctggagaacgtgggttcgcatgacatcgtggatgggaatcaccggctgacgctggggctggtctggaccatcatcctgcgcttccagattcaagtcatcaaaattgagactgaggacaacagagagacacgctcagccaaggatgctctgctcttgtggtgtcagatgaagacagctggttaccctgaggtaaacatccagaatttcaccaccagctggcgggatggcttggccttcaatgccctcattcaccggcacaggcctgatctcgtggacttcagcaaactcaccaagtccaatgccaactacaacctgcagagagccttccgcacagctgagcagcacctggggctggcgcggctgctggatcctgaagatgtgaacatggaggctccagatgagaagtccatcatcacctacgtggtctctttctaccactatttctccaagatgaaggctctggctgtggaggggaagcgtatcgggaaggtcttggaccaggtattggaggtggggaagatcatagaacgctacgaggagctggcggctgagctgctggcctggatccaccgcaccgtgggcctcatcagcaatcagaaatttgccaactccttaagtggggtgcagcagcaactccaggctttcacggcctattgcacgctggagaagcctgtcaagttccaggagaaggggaacctagaggtgctgctcttcagcatccagagcaaactgcgtgcctgcaaccgtcgcctctttgtgcctcgggagggctgtggcatctgggatattgacaaggcatggggtgagctggagaaggctgagcatgagcgggaggctgccctacgggctgagctgattcggcaggagaagctggaactactggcacagaggtttgaccacaaggtggctatgagggagagctggctgaatgagaaccagcgtctggtctcccaggacaactttgggtatgagctgcccgcagtggaggcagccatgaagaaacacgaagcgatcgaggcagacattgcggcctacgaggagcgggtgcagggtgtggcggagctggcccaggcattggcagccgaaggctactacgatatccggcgggtggcagcccagcgtgacagcgtcctgcgccagtgggccctgctaactgggcttgtgggtgcccggcggacacgacttgagcagaaccttgccctgcagaaggtcttccaggagatggtgtacatggtggactggatggaggagatgcaggctcagctgctgtcccgggagtgtgggcagcacctggtggaggcagacgacctgttgcagaagcatggactgctggagggagacattgccgcccagagcgagcgggtggaggctctcaatgccgctgccctgcgcttctcccagctgcagggctaccagccctgcgacccgcaggtcatctgcaaccgcgtgaaccacgtgcacggctgcctggcggagctgcaggagcaggcagcgcggcgacgcgcggagctggaggcttcgcggagcctgtgggcgctgctgcaggagctggaggaggccgagagctgggcgcgcgacaaggagcgtctcctggaggctgcgggcggcggcggtgcggcgggcgcagcgggcgcagcgggaacagcgggcggcgcgcatgacctgtccagcacagcgcgcctcctggcccagcacaagatcctgcagggcgagctgggcgggcggcgagcgttgctgcagcaggccctgcggtgtggcgaggagctggttgcggccggcggtgccgtcggcccgggagcagacaccgtgcacctggtaggcctggcggagcgcgcggcgagcgcccggcgccgctggcagaggctggaagaggcggcggcgcggcgagagcggcggctgcaggaggcgcgggcgctgcaccagttcggcgctgacctcgacgggctgctggactggcttcgcgacgcttaccgcctggcagccgccggtgacttcggccacgacgaagcttccagccgccgcctggcgcgccagcaccgcgcgctcaccggggaggtggaggcacatcgcgggcccgtgagcggcctgcggcgccagctggcgacactcgggggtgccagtggcgcagggccactggtggtggcgctgcaggtgcgcgtggtggaagcagagcagttgttcgctgaggtgaccgaagtggcggcgctgaggcgccagtggctgcgggacgcgctcgctgtctaccgcatgtttggcgaggtgcacgcgtgtgagctgtggatcggcgagaaggagcaatggctgctctccatgcgtgtgccggattcactcgacgacgtcgaggtggtgcagcaccgattcgagagcctggaccaagagatgaacagcctgatgggccgcgttctggacgtgaaccacacagtccaggagctggtggaaggaggccaccccagttcagatgaggtgcgttcctgccaggaccacctcaacagcaggtggaaccgcatcgtggagctagtggaacagcgcaaagaggaaatgagcgcggtgctgctggtggagaaccacgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggcccgggcctggcactagacgagtggctgccacacctcgaacttggctggcataaactgctcggcttgtgggaggcgcgcagggaggcgctggtccaggcgcacatctaccagctcttcctgcgggatctacgccaggcgctcgtggtgctgcgtaaccaggagatggcgctgtctggtgcggagctcccgggcacagtggaatcggtggaggaggccttgaaacagcaccgtgactttctcaccaccatggagctgagccagcaaaagatgcaggtggccgtgcaggctgcagagggcctgctgaggcagggcaacatctacggggagcaggctcaggaggctgtgacccggctgctggagaagaaccaagaaaaccagttacgggcccagcaatggatgcaaaagctacatgaccaacttgagctgcagcacttcctccgagactgccacgagctggatggctggatccatgagaagatgctgatggcgcgggatggcacgcgggaggacaaccacaagctgcataagagatggctccggcaccaggcattcatggccgagctggctcagaataaggagtggctggagaagatcgagcgggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcagtccatggagtcgcaggtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgactggacgacgagctgggcatgggttcaggagcggctgccactggccatgcagacagagcgaggcaacggtttgcaggcggtccagcagcacatcaaaaagaaccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggacgaacagagcaccctgcagctgctcaagaaacacctgcagctggagcaaggcgtggagaactacgaggaaagcatcgcgcagctgtcgcgccagtgccgggcgctgctggagatggggcacccggacagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccagggacgtgtcatcagtggaggtgctcatgaactaccaccagggcctgaagactgagctggaggcgcgggtgcctgagctgaccacctgccaggagctggggcgatctctgctgctcaacaaaagtgccatggctgatgagatccaggcacagctggacaagctgggaaccaggaaggaggaggtgtcggaaaagtgggaccgccattgggagtggctgcagcagatgctggaggtgcaccagtttgcccaggaggcggtggtggctgatgcctggctgacagcccaggagccgctcctgcagagccgggagctgggcagcagcgtggatgaggtggagcagcttatccggcgacatgaggccttccgcaaagcggctgcagcctgggaagagaggttcagctctctgcggcgcctgaccacgatcgagaaaatcaaagcggaacagagcaagcagccgcctaccccactgctggggcgcaagttctttggggaccccacggaactggcggccaaggcggcgcccctgctgcggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggccgcaccagaggacgcggcggagacccccgcgacccccgcggcggcggagcaggtgcggccacgaccggagcgccaggagtcagctgatcgcgcggaggagctgcccaggaggcggcggcctgagcggcaagagtcagtcgatcaatccgaggaggctgcgcggaggcggcggccggagcggcaggagtcagcggagcacgaggcggcacacagccttaccctgggccgctatgagcagatggagcggcggcgcgagcggcgtgagcggcgcttggagcggcaggagtccagcgaacaggagatgcccatcagaggagacctggtcaaggggaaggccaccctggctgacattgtggaacagctgcaggagaaagaggcaggcccagggctgcctgctgggccgtcgctgcctcagccacgcgagcttcccccaggtcgcctgcccaacgggcttgagctgcccgagcggacacctcggccggaccggccccgggcgcgggaccggcccaagccgcgacggcggccgcggcccagagagggtggtgagggcgggggaagccggcgctcgcgctccgccccggcccagggcggctccgcccccgcgcctccgccaccgcccactcacacagtgcagcacgagggcttcctactgcgcaagcgcgagctcgacgctaaccgcaagtcgtccaaccggtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtgactacaagaaaaagaagcatgtcttcaagctccagacccaggatggcagtgagtttttgctccaggcaaaagatgaggaggagatgaacggctggctggaggctgtagcttcctcggtggcggaacacgcagagatcgcccgctggggccagacactacccactacttcatccacagatgagggcaaccctaagagggaaggcggagatcgcagggccagcgggcgcaggaagtgacttcccacccccaggacctgacacatctcgtctcccctcttttccgcactgtgggcacaaagacactttttcttccgcaggggcgggagcccctagttccaacactgaggacgcgtgacatggtgggcaccggaaaggaggggacttctcctgcaccccaagaagtggtggggagattgctgcccctatagccatatctcggccccttcccactcaccacccccaccccaggtgctgggggtcccttatttttatgcaataactgagcttgatgggggtgggcagggggccagttgagccaagcccccagccccgatctgcagatcctgccccaagaagctggggtggtgggggcagtaattcctgcccccctctctgccctagggatgggcacgggggcgctggtgaggtcccctggaccatccagggtgctagggggcagggaggggacaccccctccccgcctttacctcacttccaatgctgccttgatctctgtctgggaggggggagtgaaggggccctagccccctgcactccgccgcctcagagccatgcggttaattcctgacttagtttatttttgcaaaacgtcgatctcctcctcccccgccccgcatccgcgaaggcttttaatgggaggggcgtcaaagctcaaaactgttttcctctctcctcccccctccagttgtaaatgccacttcatgaggggaggggcgaggggaagcccacccctgcatgcttctggctggagcacctccctggggagtcgggggattgggttgtgggcagtccccatggccgcctggagaagccgctggggcccgggggtgtggggcggtgtggcgggcgcacactgtatgtacctataataaaccctttggctttg

SEQ ID NO: 185377 - DNA, 2419 bp, Homo sapiens
  Payload ID: 16503
  Gene Symbol: SPTBN4
  Gene Name: spectrin, beta, non-erythrocytic 4
  Uniprot ID: Q9H254
  ENST ID: ENST00000392023
  CDS Start-End: 128-2164
ggagcctcagccttcgccgccgctgccgctgccgtcgcagttgaggggcgagcacccgcccgcccgctgcagggacgccccgccaacgccactgccgcttcagctggatggctggatccatgagaagatgctgatggcgcgggatggcacgcgggaggacaaccacaagctgcataagagatggctccggcaccaggcattcatggccgagctggctcagaataaggagtggctggagaagatcgagcgggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcagtccatggagtcgcaggtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgacctggacgacgagctggcatgggttcaggagcggctgccactggccatgcagacagagcgaggcaacggtttgcaggcggtccagcagcacatcaaaaagaaccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggacgaacagagcaccctgcagctgctcaagaaacacctgcagctggagcaaggcgtggagaactacgaggaaagcatcgcgcagctgtcgcgccagtgccgggcgctgctggagatggggcacccggacagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccaggtgcccctcatccctcctcgggcttcctgcctccccctggtggcctaccccagccacccccagcccattgacagcccccttctcaatggaatgacaacagccaatatctgtgtggcgcctctgtgtgctaggcactgttctaggtgcttcgtgtgtattcagaccccttttttaggcctgtcattggggacttcggtcatggggcatccttctgtccgctgtccttcccagttgcctattattaccctctccatgggatgtcacagcatgaaacaggctaaagacaggatgggcaagggaggtgtgggactgtatttgtgagggtgggtgaagaattctaacaattcca

SEQ ID NO: 185378 - DNA, 8671 bp, Homo sapiens
  Payload ID: 16503
  Gene Symbol: SPTBN4
  Gene Name: spectrin, beta, non-erythrocytic 4
  ENST ID: ENST00000392025
  CDS Start-End: 87-7781
tatgaccctgtgtgactcagtgacccggagggcaagcaggactgtgggtgacaccttgtgtcatcctctgagcctcaccttccccgatggcgcaggtaccaggggaagtggacaacatggagggcctgcctgctcctaacaacaaccctgctgcccgctgggagagtccggatcggggctgggagcgggagcagccggctgcgtccaccgcagcggcctcgctctttgagtgctcccggatcaaggccttggcagatgagcgggaagccgtgcagaagaaaaccttcaccaagtgggtgaactcgcacctcgcccgcgtgggctgccacatcggggacctctatgtggacctccgggacggcttcgtgctcacgcggctcctggaagtgctgtctggggagcagctgcccaggcccacgcgcggccgcatgcggatccactcactggagaacgtggacaaggcgctgcagtttctgaaggagcagcgcgtgcacctggagaacgtgggttcgcatgacatcgtggatgggaatcaccggctgacgctggggctggtctggaccatcatcctgcgcttccagattcaagtcatcaaaattgagactgaggacaacagagagacacgctcagccaaggatgctctgctcttgtggtgtcagatgaagacagctggttaccctgaggtaaacatccagaatttcaccaccagctggcgggatggcttggccttcaatgccctcattcaccggcacaggcctgatctcgtggacttcagcaaactcaccaagtccaatgccaactacaacctgcagagagccttccgcacagctgagcagcacctggggctggcgcggctgctggatcctgaagatgtgaacatggaggctccagatgagaagtccatcatcacctacgtggtctctttctaccactatttctccaagatgaaggctctggctgtggaggggaagcgtatcgggaaggtcttggaccaggtattggaggtggggaagatcatagaacgctacgaggagctggcggctgagctgctggcctggatccaccgcaccgtgggcctcatcagcaatcagaaatttgccaactccttaagtggggtgcagcagcaactccaggctttcacggcctattgcacgctggagaagcctgtcaagttccaggagaaggggaacctagaggtgctgctcttcagcatccagagcaaactgcgtgcctgcaaccgtcgcctctttgtgcctcgggagggctgtggcatctgggatattgacaaggcatggggtgagctggagaaggctgagcatgagcgggaggctgccctacgggctgagctgattcggcaggagaagctggaactactggcacagaggtttgaccacaaggtggctatgagggagagctggctgaatgagaaccagcgtctggtctcccaggacaactttgggtatgagctgcccgcagtggaggcagccatgaagaaacacgaagcgatcgaggcagacattgcggcctacgaggagcgggtgcagggtgtggcggagctggcccaggcattggcagccgaaggctactacgatatccggcgggtggcagcccagcgtgacagcgtcctgcgccagtgggccctgctaactgggcttgtgggtgcccggcggacacgacttgagcagaaccttgccctgcagaaggtcttccaggagatggtgtacatggtggactggatggaggagatgcaggctcagctgctgtcccgggagtgtgggcagcacctggtggaggcagacgacctgttgcagaagcatggactgctggagggagacattgccgcccagagcgagcgggtggaggctctcaatgccgctgccctgcgcttctcccagctgcagggctaccagccctgcgacccgcaggtcatctgcaaccgcgtgaaccacgtgcacggctgcctggcggagctgcaggagcaggcagcgcggcgacgcgcggagctggaggcttcgcggagcctgtgggcgctgctgcaggagctggaggaggccgagagctgggcgcgcgacaaggagcgtctcctggaggctgcgggcggcggcggtgcggcgggcgcagcgggcgcagcgggaacagcgggcggcgcgcatgacctgtccagcacagcgcgcctcctggcccagcacaagatcctgcagggcgagctgggcgggcggcgagcgttgctgcagcaggccctgcggtgtggcgaggagctggttgcggccggcggtgccgtcggcccgggagcagacaccgtgcacctggtaggcctggcggagcgcgcggcgagcgcccggcgccgctggcagaggctggaagaggcggcggcgcggcgagagcggcggctgcaggaggcgcgggcgctgcaccagttcggcgctgacctcgacgggctgctggactggcttcgcgacgcttaccgcctggcagccgccggtgacttcggccacgacgaagcttccagccgccgcctggcgcgccagcaccgcgcgctcaccggggaggtggaggcacatcgcgggcccgtgagcggcctgcggcgccagctggcgacactcgggggtgccagtggcgcagggccactggtggtggcgctgcaggtgcgcgtggtggaagcagagcagttgttcgctgaggtgaccgaagtggcggcgctgaggcgccagtggctgcgggacgcgctcgctgtctaccgcatgtttggcgaggtgcacgcgtgtgagctgtggatcggcgagaaggagcaatggctgctctccatgcgtgtgccggattcactcgacgacgtcgaggtggtgcagcaccgattcgagagcctggaccaagagatgaacagcctgatgggccgcgttctggacgtgaaccacacagtccaggagctggtggaaggaggccaccccagttcagatgaggtgcgttcctgccaggaccacctcaacagcaggtggaaccgcatcgtggagctagtggaacagcgcaaagaggaaatgagcgcggtgctgctggtggagaaccacgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggcccgggcctggcactagacgagtggctgccacacctcgaacttggctggcataaactgctcggcttgtgggaggcgcgcagggaggcgctggtccaggcgcacatctaccagctcttcctgcgggatctacgccaggcgctcgtggtgctgcgtaaccaggagatggcgctgtctggtgcggagctcccgggcacagtggaatcggtggaggaggccttgaaacagcaccgtgactttctcaccaccatggagctgagccagcaaaagatgcaggtggccgtgcaggctgcagagggcctgctgaggcagggcaacatctacggggagcaggctcaggaggctgtgacccggctgctggagaagaaccaagaaaaccagttacgggcccagcaatggatgcaaaagctacatgaccaacttgagctgcagcacttcctccgagactgccacgagctggatggctggatccatgagaagatgctgatggcgcgggatggcacgcgggaggacaaccacaagctgcataagagatggctccggcaccaggcattcatggccgagctggctcagaataaggagtggctggagaagatcgagcgggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcagtccatggagtcgcaggtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgactggacgacgagctgggcatgggttcaggagcggctgccactggccatgcagacagagcgaggcaacggtttgcaggcggtccagcagcacatcaaaaagaaccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggacgaacagagcaccctgcagctgctcaagaaacacctgcagctggagcaaggcgtggagaactacgaggaaagcatcgcgcagctgtcgcgccagtgccgggcgctgctggagatggggcacccggacagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccagggacgtgtcatcagtggaggtgctcatgaactaccaccagggcctgaagactgagctggaggcgcgggtgcctgagctgaccacctgccaggagctggggcgatctctgctgctcaacaaaagtgccatggctgatgagatccaggcacagctggacaagctgggaaccaggaaggaggaggtgtcggaaaagtgggaccgccattgggagtggctgcagcagatgctggaggtgcaccagtttgcccaggaggcggtggtggctgatgcctggctgacagcccaggagccgctcctgcagagccgggagctgggcagcagcgtggatgaggtggagcagcttatccggcgacatgaggccttccgcaaagcggctgcagcctgggaagagaggttcagctctctgcggcgcctgaccacgatcgagaaaatcaaagcggaacagagcaagcagccgcctaccccactgctggggcgcaagttctttggggaccccacggaactggcggccaaggcggcgcccctgctgcggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggccgcaccagaggacgcggcggagacccccgcgacccccgcggcggcggagcaggtgcggccacgaccggagcgccaggagtcagctgatcgcgcggaggagctgcccaggaggcggcggcctgagcggcaagagtcagtcgatcaatccgaggaggctgcgcggaggcggcggccggagcggcaggagtcagcggagcacgaggcggcacacagccttaccctgggccgctatgagcagatggagcggcggcgcgagcggcgtgagcggcgcttggagcggcaggagtccagcgaacaggagatgcccatcagaggagacctggtcaaggggaaggccaccctggctgacattgtggaacagctgcaggagaaagaggcaggcccagggctgcctgctgggccgtcgctgcctcagccacgcgagcttcccccaggtcgcctgcccaacgggcttgagctgcccgagcggacacctcggccggaccggccccgggcgcgggaccggcccaagccgcgacggcggccgcggcccagagagggtggtgagggcgggggaagccggcgctcgcgctccgccccggcccagggcggctccgcccccgcgcctccgccaccgcccactcacacagtgcagcacgagggcttcctactgcgcaagcgcgagctcgacgctaaccgcaagtcgtccaaccggtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtgactacaagaaaaagaagcatgtcttcaagctccagacccaggatggcagtgagtttttgctccaggcaaaagatgaggaggagatgaacggctggctggaggctgtagcttcctcggtggcggaacacgcagagatcgcccgctggggccagacactacccactacttcatccacagatgagggcaaccctaagagggaaggcggagatcgcagggccagcgggcgcaggaagtgacttcccacccccaggacctgacacatctcgtctcccctcttttccgcactgtgggcacaaagacactttttcttccgcaggggcgggagcccctagttccaacactgaggacgcgtgacatggtgggcaccggaaaggaggggacttctcctgcaccccaagaagtggtggggagattgctgcccctatagccatatctcggccccttcccactcaccacccccaccccaggtgctgggggtcccttatttttatgcaataactgagcttgatgggggtgggcagggggccagttgagccaagcccccagccccgatctgcagatcctgccccaagaagctggggtggtgggggcagtaattcctgcccccctctctgccctagggatgggcacgggggcgctggtgaggtcccctggaccatccagggtgctagggggcagggaggggacaccccctccccgcctttacctcacttccaatgctgccttgatctctgtctgggaggggggagtgaaggggccctagccccctgcactccgccgcctcagagccatgcggttaattcctgacttagtttatttttgcaaaacgtcgatctcctcctcccccgccccgcatccgcgaaggcttttaatgggaggggcgtcaaagctcaaaactgttttcctctctcctcccccctccagttgtaaatgccacttcatgaggggaggggcgaggggaagcccacccctgcatgcttctggctggagcacctccctggggagtcgggggattgggttgtgggcagtccccatggccgcctggagaagccgctggggcccgggggtgtggggcggtgtggcgggcgcacactgtatgtacctataataaaccctttggctttga

SEQ ID NO: 185379 - DNA, 8070 bp, Homo sapiens
  Payload ID: 16503
  Gene Symbol: SPTBN4
  Gene Name: spectrin, beta, non-erythrocytic 4
  Uniprot ID: Q9H254
  ENST ID: ENST00000598249
  CDS Start-End: 103-7797
ggccgggccgggcagcggacgccgacagggagggcggtcggtcgcggcgagcagcggagacagcgacgctggcggccgcgggcccaggcctcaccttccccgatggcgcaggtaccaggggaagtggacaacatggagggcctgcctgctcctaacaacaaccctgctgcccgctgggagagtccggatcggggctgggagcgggagcagccggctgcgtccaccgcagcggcctcgctctttgagtgctcccggatcaaggccttggcagatgagcgggaagccgtgcagaagaaaaccttcaccaagtgggtgaactcgcacctcgcccgcgtgggctgccacatcggggacctctatgtggacctccgggacggcttcgtgctcacgcggctcctggaagtgctgtctggggagcagctgcccaggcccacgcgcggccgcatgcggatccactcactggagaacgtggacaaggcgctgcagtttctgaaggagcagcgcgtgcacctggagaacgtgggttcgcatgacatcgtggatgggaatcaccggctgacgctggggctggtctggaccatcatcctgcgcttccagattcaagtcatcaaaattgagactgaggacaacagagagacacgctcagccaaggatgctctgctcttgtggtgtcagatgaagacagctggttaccctgaggtaaacatccagaatttcaccaccagctggcgggatggcttggccttcaatgccctcattcaccggcacaggcctgatctcgtggacttcagcaaactcaccaagtccaatgccaactacaacctgcagagagccttccgcacagctgagcagcacctggggctggcgcggctgctggatcctgaagatgtgaacatggaggctccagatgagaagtccatcatcacctacgtggtctctttctaccactatttctccaagatgaaggctctggctgtggaggggaagcgtatcgggaaggtcttggaccaggtattggaggtggggaagatcatagaacgctacgaggagctggcggctgagctgctggcctggatccaccgcaccgtgggcctcatcagcaatcagaaatttgccaactccttaagtggggtgcagcagcaactccaggctttcacggcctattgcacgctggagaagcctgtcaagttccaggagaaggggaacctagaggtgctgctcttcagcatccagagcaaactgcgtgcctgcaaccgtcgcctctttgtgcctcgggagggctgtggcatctgggatattgacaaggcatggggtgagctggagaaggctgagcatgagcgggaggctgccctacgggctgagctgattcggcaggagaagctggaactactggcacagaggtttgaccacaaggtggctatgagggagagctggctgaatgagaaccagcgtctggtctcccaggacaactttgggtatgagctgcccgcagtggaggcagccatgaagaaacacgaagcgatcgaggcagacattgcggcctacgaggagcgggtgcagggtgtggcggagctggcccaggcattggcagccgaaggctactacgatatccggcgggtggcagcccagcgtgacagcgtcctgcgccagtgggccctgctaactgggcttgtgggtgcccggcggacacgacttgagcagaaccttgccctgcagaaggtcttccaggagatggtgtacatggtggactggatggaggagatgcaggctcagctgctgtcccgggagtgtgggcagcacctggtggaggcagacgacctgttgcagaagcatggactgctggagggagacattgccgcccagagcgagcgggtggaggctctcaatgccgctgccctgcgcttctcccagctgcagggctaccagccctgcgacccgcaggtcatctgcaaccgcgtgaaccacgtgcacggctgcctggcggagctgcaggagcaggcagcgcggcgacgcgcggagctggaggcttcgcggagcctgtgggcgctgctgcaggagctggaggaggccgagagctgggcgcgcgacaaggagcgtctcctggaggctgcgggcggcggcggtgcggcgggcgcagcgggcgcagcgggaacagcgggcggcgcgcatgacctgtccagcacagcgcgcctcctggcccagcacaagatcctgcagggcgagctgggcgggcggcgagcgttgctgcagcaggccctgcggtgtggcgaggagctggttgcggccggcggtgccgtcggcccgggagcagacaccgtgcacctggtaggcctggcggagcgcgcggcgagcgcccggcgccgctggcagaggctggaagaggcggcggcgcggcgagagcggcggctgcaggaggcgcgggcgctgcaccagttcggcgctgacctcgacgggctgctggactggcttcgcgacgcttaccgcctggcagccgccggtgacttcggccacgacgaagcttccagccgccgcctggcgcgccagcaccgcgcgctcaccggggaggtggaggcacatcgcgggcccgtgagcggcctgcggcgccagctggcgacactcgggggtgccagtggcgcagggccactggtggtggcgctgcaggtgcgcgtggtggaagcagagcagttgttcgctgaggtgaccgaagtggcggcgctgaggcgccagtggctgcgggacgcgctcgctgtctaccgcatgtttggcgaggtgcacgcgtgtgagctgtggatcggcgagaaggagcaatggctgctctccatgcgtgtgccggattcactcgacgacgtcgaggtggtgcagcaccgattcgagagcctggaccaagagatgaacagcctgatgggccgcgttctggacgtgaaccacacagtccaggagctggtggaaggaggccaccccagttcagatgaggtgcgttcctgccaggaccacctcaacagcaggtggaaccgcatcgtggagctagtggaacagcgcaaagaggaaatgagcgcggtgctgctggtggagaaccacgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggcccgggcctggcactagacgagtggctgccacacctcgaacttggctggcataaactgctcggcttgtgggaggcgcgcagggaggcgctggtccaggcgcacatctaccagctcttcctgcgggatctacgccaggcgctcgtggtgctgcgtaaccaggagatggcgctgtctggtgcggagctcccgggcacagtggaatcggtggaggaggccttgaaacagcaccgtgactttctcaccaccatggagctgagccagcaaaagatgcaggtggccgtgcaggctgcagagggcctgctgaggcagggcaacatctacggggagcaggctcaggaggctgtgacccggctgctggagaagaaccaagaaaaccagttacgggcccagcaatggatgcaaaagctacatgaccaacttgagctgcagcacttcctccgagactgccacgagctggatggctggatccatgagaagatgctgatggcgcgggatggcacgcgggaggacaaccacaagctgcataagagatggctccggcaccaggcattcatggccgagctggctcagaataaggagtggctggagaagatcgagcgggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcagtccatggagtcgcaggtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgacctggacgacgagctggcatgggttcaggagcggctgccactggccatgcagacagagcgaggcaacggtttgcaggcggtccagcagcacatcaaaaagaaccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggacgaacagagcaccctgcagctgctcaagaaacacctgcagctggagcaaggcgtggagaactacgaggaaagcatcgcgcagctgtcgcgccagtgccgggcgctgctggagatggggcacccggacagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccagggacgtgtcatcagtggaggtgctcatgaactaccaccagggcctgaagactgagctggaggcgcgggtgcctgagctgaccacctgccaggagctggggcgatctctgctgctcaacaaaagtgccatggctgatgagatccaggcacagctggacaagctgggaaccaggaaggaggaggtgtcggaaaagtgggaccgccattgggagtggctgcagcagatgctggaggtgcaccagtttgcccaggaggcggtggtggctgatgcctggctgacagcccaggagccgctcctgcagagccgggagctgggcagcagcgtggatgaggtggagcagcttatccggcgacatgaggccttccgcaaagcggctgcagcctgggaagagaggttcagctctctgcggcgcctgaccacgatcgagaaaatcaaagcggaacagagcaagcagccgcctaccccactgctggggcgcaagttctttggggaccccacggaactggcggccaaggcggcgcccctgctgcggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggccgcaccagaggacgcggcggagacccccgcgacccccgcggcggcggagcaggtgcggccacgaccggagcgccaggagtcagctgatcgcgcggaggagctgcccaggaggcggcggcctgagcggcaagagtcagtcgatcaatccgaggaggctgcgcggaggcggcggccggagcggcaggagtcagcggagcacgaggcggcacacagccttaccctgggccgctatgagcagatggagcggcggcgcgagcggcgtgagcggcgcttggagcggcaggagtccagcgaacaggagatgcccatcagaggagacctggtcaaggggaaggccaccctggctgacattgtggaacagctgcaggagaaagaggcaggcccagggctgcctgctgggccgtcgctgcctcagccacgcgagcttcccccaggtcgcctgcccaacgggcttgagctgcccgagcggacacctcggccggaccggccccgggcgcgggaccggcccaagccgcgacggcggccgcggcccagagagggtggtgagggcgggggaagccggcgctcgcgctccgccccggcccagggcggctccgcccccgcgcctccgccaccgcccactcacacagtgcagcacgagggcttcctactgcgcaagcgcgagctcgacgctaaccgcaagtcgtccaaccggtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtgactacaagaaaaagaagcatgtcttcaagctccagacccaggatggcagtgagtttttgctccaggcaaaagatgaggaggagatgaacggctggctggaggctgtagcttcctcggtggcggaacacgcagagatcgcccgctggggccagacactacccactacttcatccacagatgagggcaaccctaagagggaaggcggagatcgcagggccagcgggcgcaggaagtgacttcccacccccaggacctgacacatctcgtctcccctcttttccgcactgtgggcacaaagacactttttcttccgcaggggcgggagcccctagttccaacactgaggacgcgtgacatggtgggcaccggaaaggaggggacttctcctgcaccccaagaagtggtggggagattgctgcccctatagccatatctcggccccttcccactcaccacccccaccccaggtgctgggggtcccttatttttatgcaataactgagcttgat

SEQ ID NO: 185380 - DNA, 6105 bp, Homo sapiens
  Payload ID: 16503
  Gene Symbol: SPTBN4
  Gene Name: spectrin, beta, non-erythrocytic 4
  ENST ID: ENST00000595535
  CDS Start-End: 87-6095
tatgaccctgtgtgactcagtgacccggagggcaagcaggactgtgggtgacaccttgtgtcatcctctgagcctcaccttccccgatggcgcaggtaccaggggaagtggacaacatggagggcctgcctgctcctaacaacaaccctgctgcccgctgggagagtccggatcggggctgggagcgggagcagccggctgcgtccaccgcagcggcctcgctctttgagtgctcccggatcaaggccttggcagatgagcgggaagccgtgcagaagaaaaccttcaccaagtgggtgaactcgcacctcgcccgcgtgggctgccacatcggggacctctatgtggacctccgggacggcttcgtgctcacgcggctcctggaagtgctgtctggggagcagctgcccaggcccacgcgcggccgcatgcggatccactcactggagaacgtggacaaggcgctgcagtttctgaaggagcagcgcgtgcacctggagaacgtgggttcgcatgacatcgtggatgggaatcaccggctgacgctggggctggtctggaccatcatcctgcgcttccagattcaagtcatcaaaattgagactgaggacaacagagagacacgctcagccaaggatgctctgctcttgtggtgtcagatgaagacagctggttaccctgaggtaaacatccagaatttcaccaccagctggcgggatggcttggccttcaatgccctcattcaccggcacaggcctgatctcgtggacttcagcaaactcaccaagtccaatgccaactacaacctgcagagagccttccgcacagctgagcagcacctggggctggcgcggctgctggatcctgaagatgtgaacatggaggctccagatgagaagtccatcatcacctacgtggtctctttctaccactatttctccaagatgaaggctctggctgtggaggggaagcgtatcgggaaggtcttggaccaggtattggaggtggggaagatcatagaacgctacgaggagctggcggctgagctgctggcctggatccaccgcaccgtgggcctcatcagcaatcagaaatttgccaactccttaagtggggtgcagcagcaactccaggctttcacggcctattgcacgctggagaagcctgtcaagttccaggagaaggggaacctagaggtgctgctcttcagcatccagagcaaactgcgtgcctgcaaccgtcgcctctttgtgcctcgggagggctgtggcatctgggatattgacaaggcatggggtgagctggagaaggctgagcatgagcgggaggctgccctacgggctgagctgattcggcaggagaagctggaactactggcacagaggtttgaccacaaggtggctatgagggagagctggctgaatgagaaccagcgtctggtctcccaggacaactttgggtatgagctgcccgcagtggaggcagccatgaagaaacacgaagcgatcgaggcagacattgcggcctacgaggagcgggtgcagggtgtggcggagctggcccaggcattggcagccgaaggctactacgatatccggcgggtggcagcccagcgtgacagcgtcctgcgccagtgggccctgctaactgggcttgtgggtgcccggcggacacgacttgagcagaaccttgccctgcagaaggtcttccaggagatggtgtacatggtggactggatggaggagatgcaggctcagctgctgtcccgggagtgtgggcagcacctggtggaggcagacgacctgttgcagaagcatggactgctggagggagacattgccgcccagagcgagcgggtggaggctctcaatgccgctgccctgcgcttctcccagctgcagggctaccagccctgcgacccgcaggtcatctgcaaccgcgtgaaccacgtgcacggctgcctggcggagctgcaggagcaggcagcgcggcgacgcgcggagctggaggcttcgcggagcctgtgggcgctgctgcaggagctggaggaggccgagagctgggcgcgcgacaaggagcgtctcctggaggctgcgggcggcggcggtgcggcgggcgcagcgggcgcagcgggaacagcgggcggcgcgcatgacctgtccagcacagcgcgcctcctggcccagcacaagatcctgcagggcgagctgggcgggcggcgagcgttgctgcagcaggccctgcggtgtggcgaggagctggttgcggccggcggtgccgtcggcccgggagcagacaccgtgcacctggtaggcctggcggagcgcgcggcgagcgcccggcgccgctggcagaggctggaagaggcggcggcgcggcgagagcggcggctgcaggaggcgcgggcgctgcaccagttcggcgctgacctcgacgggctgctggactggcttcgcgacgcttaccgcctggcagccgccggtgacttcggccacgacgaagcttccagccgccgcctggcgcgccagcaccgcgcgctcaccggggaggtggaggcacatcgcgggcccgtgagcggcctgcggcgccagctggcgacactcgggggtgccagtggcgcagggccactggtggtggcgctgcaggtgcgcgtggtggaagcagagcagttgttcgctgaggtgaccgaagtggcggcgctgaggcgccagtggctgcgggacgcgctcgctgtctaccgcatgtttggcgaggtgcacgcgtgtgagctgtggatcggcgagaaggagcaatggctgctctccatgcgtgtgccggattcactcgacgacgtcgaggtggtgcagcaccgattcgagagcctggaccaagagatgaacagcctgatgggccgcgttctggacgtgaaccacacagtccaggagctggtggaaggaggccaccccagttcagatgaggtgcgttcctgccaggaccacctcaacagcaggtggaaccgcatcgtggagctagtggaacagcgcaaagaggaaatgagcgcggtgctgctggtggagaaccacgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggcccgggcctggcactagacgagtggctgccacacctcgaacttggctggcataaactgctcggcttgtgggaggcgcgcagggaggcgctggtccaggcgcacatctaccagctcttcctgcgggatctacgccaggcgctcgtggtgctgcgtaaccaggagatggcgctgtctggtgcggagctcccgggcacagtggaatcggtggaggaggccttgaaacagcaccgtgactttctcaccaccatggagctgagccagcaaaagatgcaggtggccgtgcaggctgcagagggcctgctgaggcagggcaacatctacggggagcaggctcaggaggctgtgacccggctgctggagaagaaccaagaaaaccagttacgggcccagcaatggatgcaaaagctacatgaccaacttgagctgcagcacttcctccgagactgccacgagctggatggctggatccatgagaagatgctgatggcgcgggatggcacgcgggaggacaaccacaagctgcataagagatggctccggcaccaggcattcatggccgagctggctcagaataaggagtggctggagaagatcgagcgggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcagtccatggagtcgcaggtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgacctggacgacgagctggcatgggttcaggagcggctgccactggccatgcagacagagcgaggcaacggtttgcaggcggtccagcagcacatcaaaaagaaccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggacgaacagagcaccctgcagctgctcaagaaacacctgcagctggagcaaggcgtggagaactacgaggaaagcatcgcgcagctgtcgcgccagtgccgggcgctgctggagatggggcacccggacagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccaggtgcccctcatccctcctcgggcttcctgcctccccctggtggcctaccccagccacccccagcccattgacagcccccttctcaatggaatgacaacagccaa

SEQ ID NO: 185381 - DNA, 5957 bp, Homo sapiens
  Payload ID: 16503
  Gene Symbol: SPTBN4
  Gene Name: spectrin, beta, non-erythrocytic 4
  ENST ID: ENST00000597389
  CDS Start-End: 1-2106
ccctgcgacccgcaggtcatctgcaaccgcgtgaaccacgtgcacggctgcctggcggagctgcaggagcaggcagcgcggcgacgcgcggagctggaggcttcgcggagcctgtgggcgctgctgcaggagctggaggaggccgagagctgggcgcgcgacaaggagcgtctcctggaggctgcgggcggcggcggtgcggcgggcgcagcgggcgcagcgggaacagcgggcggcgcgcatgacctgtccagcacagcgcgcctcctggcccagcacaagatcctgcagggcgagctgggcgggcggcgagcgttgctgcagcaggccctgcggtgtggcgaggagctggttgcggccggcggtgccgtcggcccgggagcagacaccgtgcacctggtaggcctggcggagcgcgcggcgagcgcccggcgccgctggcagaggctggaagaggcggcggcgcggcgagagcggcggctgcaggaggcgcgggcgctgcaccagttcggcgctgacctcgacgggctgctggactggcttcgcgacgcttaccgcctggcagccgccggtgacttcggccacgacgaagcttccagccgccgcctggcgcgccagcaccgcgcgctcaccggggaggtggaggcacatcgcgggcccgtgagcggcctgcggcgccagctggcgacactcgggggtgccagtggcgcagggccactggtggtggcgctgcaggtgcgcgtggtggaagcagagcagttgttcgctgaggtgaccgaagtggcggcgctgaggcgccagtggctgcgggacgcgctcgctgtctaccgcatgtttggcgaggtgcacgcgtgtgagctgtggatcggcgagaaggagcaatggctgctctccatgcgtgtgccggattcactcgacgacgtcgaggtggtgcagcaccgattcgagagcctggaccaagagatgaacagcctgatgggccgcgttctggacgtgaaccacacagtccaggagctggtggaaggaggccaccccagttcagatgaggtgcgttcctgccaggaccacctcaacagcaggtggaaccgcatcgtggagctagtggaacagcgcaaagaggaaatgagcgcggtgctgctggtggagaaccacgtgctggaggtggccgaggtgcgcgcccaggtgcgtgagaagcggagagctgtggagagcgcgccccgggccggcggcgccctgcagtggcgtcttagcggcctagaggccgctctgcaggcgctggagccgcgccaggcggcccttctggaggaggcagccctgctggctgagcgcttcccggcgcaggcggcgcggctgcaccagggcgcggaggagctgggcgccgagtggggcgcgctagctagcgcggctcaggcctgcggcgaggcggtggcggcagcagggcgcctgcagcgcttcctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggcccgggcctggcactagacgagtggctgccacacctcgaacttggctggcataaactgctcggcttgtgggaggcgcgcagggaggcgctggtccaggcgcacatctaccagctcttcctgcgggatctacgccaggcgctcgtggtgctgcgtaaccaggagatggcgctgtctggtgcggagctcccgggcacagtggaatcggtggaggaggccttgaaacagcaccgtgactttctcaccaccatggagctgagccagcaaaagatgcaggtggccgtgcaggctgcagagggcctgctgaggcagggcaacatctacggggagcaggctcaggaggctgtgacccggctgctggagaaatgcctcattatccatcctgctcttctgcaccctccttgggaacccccagacctccccagatccagcagctagaggccaggcacaggaaccaagaaaaccagttacgggcccagcaatggatgcaaaagctacatgaccaacttgagctgcagcacttcctccgagactgccacgagctggatggctggatccatgagaagatgctgatggcgcgggatggcacgcgggaggacaaccacaagctgcataagagatggctccggcaccaggcattcatggccgagctggctcagaataaggagtggctggagaagatcgagcgggagggccagcaactgatgcaggagaagcccgaactggcggcctccgtgcggaagaagctgggcgagatccgccagtgctgggcggagctggagagcaccacccaggccaaggcacggcagctctttgaggccagcaaagcagaccagctggtgcagagctttgctgagctggacaagaagctccttcacatggagagccagctgcaagacgtggaccctggaggagacctggccactgtcaacagtcagctcaagaagctgcagtccatggagtcgcaggtggaggagtggtaccgcgaggtgggagagctgcaggcgcagacggcggcgctgccgctggagccggcgagcaaggagctggtgggtgagcggcagaacgcggtgggcgagcgcctggtgcgcctgctcgagccgttgcaggagcgccgccgcttgctgctggcttccaaggagttgcaccaggtggcgcacgacctggacgacgagctggcatgggttcaggagcggctgccactggccatgcagacagagcgaggcaacggtttgcaggcggtccagcagcacatcaaaaagaaccagggcctgcggcgggagatccaggcgcatgggccgcgcctggaggaggtgctggagcgcgcgggcgcgctggcgtcgctgcgcagcccggaggcagaggcagtgcgccggggcctggagcagctgcagagcgcctgggccggactgcgggaggctgccgagcgacggcagcaggtgctggacgccgccttccaggtggagcagtactacttcgacgtggctgaggtggaggcgtggctgggcgagcaggagctgctcatgatgagtgaggacaagggcaaggacgaacagagcaccctgcagctgctcaagaaacacctgcagctggagcaaggcgtggagaactacgaggaaagcatcgcgcagctgtcgcgccagtgccgggcgctgctggagatggggcacccggacagcgagcagatcagccggcggcagtctcaggtggaccgcctgtacgtggcgctcaaggagctgggtgaggagcgccgggtggctctggaacagcagtactggctgtaccagctcagccgccaggtgagcgagcttgagcactggattgccgagaaggaggtggtggctggctcacccgagctcggccaggactttgagcatgtctcggtgctgcaggagaaattctcagagtttgccagcgagacaggtatggcagggcgggaacggctggcagctgtgaaccagatggtggatgagctgatcgagtgtggccatacagcagcggccaccatggccgagtggaaggacggactgaacgaggcctgggctgagctgctggagctcatgggcacacgggcccagctgctggccgcctctcgggagcttcataagttcttcagtgacgcccgagagcttcagggacagattgaggagaagcggaggcggctgccccgcctgaccaccccgcctgagccgagacccagtgccagttccatgcagcggaccctgagagcctttgagcatgacctgcagctcctcgtgtcccaggtacggcagctgcaggagggggcggcccagctgcggacggtgtatgcgggtgaacatgccgaggccatcgctagccgggagcaggaggtgctgcagggttggaaagagctgctgtcagcctgtgaggatgcccgcctgcatgtcagctccacagccgacgccctgcgcttccacagccaagtccgcgacctgctctcctggatggatggcatcgccagccagattggggcagccgacaagcccagggacgtgtcatcagtggaggtgctcatgaactaccaccagggcctgaagactgagctggaggcgcgggtgcctgagctgaccacctgccaggagctggggcgatctctgctgctcaacaaaagtgccatggctgatgagatccaggcacagctggacaagctgggaaccaggaaggaggaggtgtcggaaaagtgggaccgccattgggagtggctgcagcagatgctggaggtgcaccagtttgcccaggaggcggtggtggctgatgcctggctgacagcccaggagccgctcctgcagagccgggagctgggcagcagcgtggatgaggtggagcagcttatccggcgacatgaggccttccgcaaagcggctgcagcctgggaagagaggttcagctctctgcggcgcctgaccacgatcgagaaaatcaaagcggaacagagcaagcagccgcctaccccactgctggggcgcaagttctttggggaccccacggaactggcggccaaggcggcgcccctgctgcggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggccgcaccagaggacgcggcggagacccccgcgacccccgcggcggcggagcaggtgcggccacgaccggagcgccaggagtcagctgatcgcgcggaggagctgcccaggaggcggcggcctgagcggcaagagtcagtcgatcaatccgaggaggctgcgcggaggcggcggccggagcggcaggagtcagcggagcacgaggcggcacacagccttaccctgggccgctatgagcagatggagcggcggcgcgagcggcgtgagcggcgcttggagcggcaggagtccagcgaacaggagatgcccatcagaggagacctggtcaaggggaaggccaccctggctgacattgtggaacagctgcaggagaaagaggcaggcccagggctgcctgctgggccgtcgctgcctcagccacgcgagcttcccccaggtcgcctgcccaacgggcttgagctgcccgagcggacacctcggccggaccggccccgggcgcgggaccggcccaagccgcgacggcggccgcggcccagagagggtggtgagggcgggggaagccggcgctcgcgctccgccccggcccagggcggctccgcccccgcgcctccgccaccgcccactcacacagtgcagcacgagggcttcctactgcgcaagcgcgagctcgacgctaaccgcaagtcgtccaaccggtcgtgggtgagcctgtactgtgtgcttagtaagggggaactgggcttctacaaggactccaagggcccggcatccgggagcacacacggtggggaaccgctgctcagcctgcacaaggccaccagcgaggtggctagtgactacaagaaaaagaagcatgtcttcaagctccagacccaggatggcagtgagtttttgctccaggcaaaagatgaggaggagatgaacggctggctggaggctgtagcttcctcggtggcggaacacgcagagatcgcccgctggggccagacactacccactacttcatccacagatgagggcaaccctaagagggaaggcggagatcgcagggccagcgggcgcaggaagtga

SEQ ID NO: 185382 - DNA, 11725 bp, Homo sapiens
  Payload ID: 16504
  Gene Symbol: SPTBN5
  Gene Name: spectrin, beta, non-erythrocytic 5
  Uniprot ID: Q9NRC6
  ENST ID: ENST00000320955
  CDS Start-End: 229-11253
ggacaatgccgcctgtgtgccgtcaccccagcacgctggctcaaggggagggctgtggtgcagccctgctccagccttggcctctcctgatgtccctctccctccctccacagcccctgctatctgccatctccatccgtccagctgggccgcctctgtggaacccaggcatcaccaaggtttagggagccatccagcagctcctcatccccaaagtctgcagggctgatggctggtcagccccacagtccccgggagctcctcggggctgcagggcaccgcagcaggaggcccagcacagaactccgggtcccgcccagtccaagtctcaccatggactctcagtacgagacgggccacattcgcaagctacaggcccggcacatgcagatgcaggagaagactttcaccaagtggatcaataacgtcttccagtgcggccaggcgggcatcaagatccggaacctgtacacagagctggctgacggcatccacctcctgcggctgctggagctcatctcaggggaggccctgccacccccgagccggggccgcctgcgtgtgcacttcctggagaacagcagccgagctctggccttcctcagggccaaggtgccagtaccactcatcgggccagagaacatcgtggacggagaccagacactcatcctgggactcatctgggtcatcattctgcgtttccagatctcccacatctccttggacaaggaggagtttggggccagcgcagccctgctgtccaccaaggaagccctgctggtctggtgccagcggaagacagccagctacaccaacgtgaacattacagatttctcccgaagctggagcgatgggctgggcttcaatgccctcatccatgcccacaggccagacctgttggactacggctccctgcgtccagaccgcccactgcacaaccttgcttttgctttcctggtggctgagcaggagctgggcattgctcagctgctggaccccgaggacgtggcagccgcacagccagatgagcgctctatcatgacctacgtctccctctactaccactactgctcccgcctgcatcaggggcagactgtccagaggagactcactaagatcctgcttcagctccaggagacagagctgctgcagacccagtacgagcagctggtggctgaccttctacgctggattgcagagaagcagatgcagctggaggcgcgggattttccagactcgctgcccgccatgcggcagctactggcagcattcaccatcttccgcacccaggagaagccaccccggctacagcagcgaggggccgcagaggccctgctcttccggctacagacagcactccaagcccagaaccgcaggcccttcctgcctcatgagggcctgggccttgcagagctgtcccagtgctgggcagggctggagtgggcagaggctgcaaggagccaggccctgcagcagaggctactgcagctgcagcggctagaaaccctggcccggcgcttccagcacaaggcagccctccgggagagtttccttaaggatgcagagcaggtgctagaccaggccagagccccgccagccagcctggccacagtggaggcagccgtccagaggctgggcatgctggaggctggcatcctgccccaggaggggcgcttccaggccctggctgagatcgcagacatcctccggcaggagcagtaccacagctgggcagatgtggcccgcaggcaggaggaagttaccgtgcgctggcagaggctccttcagcatctacagggacagaggaagcaggtggcagacatgcaggctgtgctgagcctgctgcaggaggtggaggctgcctcccaccagctggaggagctgcaggagccggccaggtccaccgcctgtgggcagcagctggcagaagtggtggagctgctgcagaggcatgacctgctggaggctcaagtctcggcccacggagcccatgtgagccatcttgctcagcagacagcagagctggactcctccctgggcaccagtgtggaggtgctgcaggccaaggccaggacactggcccagctccaacagagcctggtggctcttgtcagggcccggcgggccctgctggagcagaccctgcagcgggcagagttcctgcgcaactgtgaggaggaggaagcctggctgaaggagtgcggacagcgggtggggaatgcggccctgggccgggatctcagccagatcgcaggcgccctgcagaaacacaaggccctggaagctgaggtccaccgccaccaggccgtgtgcgtagatctcgtgcggaggggacgcgacctcagcgcccgcaggcccccaacgcagccggatcccggggaacgggcagaggccgttcagggagggtggcagctgctccagacccgggtggtggggcggggcgcacggctgcagacagccctgctggtcctgcagtacttcgcggacgcggcggaggcggcttcgtggctgcgcgagcggcgatcctcgctggagagagcgtcctgcggtcaggaccaggcggccgccgagaccctgctgaggcgccacgtgcggctggagcgcgtcctgcgcgccttcgcggccgagctgcggcggctggaggagcaggggcgggcggcctcggcccgggcgtcgttattcacggtgaactctgccctgagccctccaggagaaagcctgaggaacccagggccctggagtgaggcttcctgccaccctggccctggggatgcctggaagatggccctcccagctgagcctgaccctgactttgatcccaacactatactccagacacaggaccacttgagtcaggactatgagagtctgcgggccctggcacagctccgcagggcccggttggaggaggccatggccctgttcggtttctgcagttcctgtggggagctccagttgtggctggagaagcagacagtgctgctccaaagggtgcagccccaggctgacaccctggaggtcatgcagctcaaatatgagaacttcctcactgccctggctgtgggaaagggcctctgggctgaggtcagcagctctgctgagcaactgaggcagagatatcctgggaactccacacaaatccaacgacagcaggaggaactgagccagaggtgggggcagctggaggccctgaagagggagaaggccgtgcagctggcacacagtgtggaagtgtgcagttttctgcaggagtgtggacccacacaggtccagctgcgagacgtgctcctccagctggaggccctgcagccagggagctcagaggacacctgccacgccctgcagctggcccagaagaagaccctggtgctggagaggagggtccacttcctccaaagtgtggtcgtaaaggtcgaggagccaggctacgcagagagccagcctctgcaaggacaggtggagacactgcaggggctgctgaagcaagtacaggaacaagtggcccaacgggcccggcgccaggctgagactcaggcccggcagagcttcctgcaagagagccagcaactgctactgtgggcagagagtgtccaggctcagctgcgcagcaaggaggtgtcagtggatgtggcctcggctcagcggctgctgagggagcaccaagacctgctggaggagatccacctgtggcaggagaggctgcagcagctggacgctcagagccagcccatggcagccttggactgcccagactcccaagaggtgcccaacactctgagggtcctggggcagcagggccaggagctgaaggttttgtgggagcagaggcagcagtggctgcaagaggggctggagctgcagaagtttggccgagaagtggatggtttcactgccacctgtgccaaccaccaggcctggctgcacctggacaaccttggggaggacgtgagggaggccctgagcctgctgcagcagcaccgggagtttgggcggctcctgagcaccctggggcctcgggcagaggctctgcgggcacacggcgagaagctggttcagagccagcacccagctgcacacacggtcagagagcagctgcagagtatccaggcacagtggaccaggctccaggggaggagtgagcagaggaggaggcagttgctggcttccctccagctccaggagtggaagcaggatgtggcagagctgatgcagtggatggaagagaaggggctgatggctgcgcatgagccctccggagcgcgcagaaacatcctgcagacactcaagcggcacgaagcagctgagagcgagctactcgccacccgcagacacgtggaggccctgcagcaggttgggagagagctgttgagtaggaggccctgtggccaggaggacatacagaccaggcttcaaggcctgagaagcaagtgggaagctttgaaccgcaagatgactgagcgtggggacgagctccagcaggctggacagcaggagcaactcctgaggcagctgcaggatgcaaaggagcagctggagcagctcgaaggggccctacagagctcggaaacagggcaggacctgcgctccagccagaggctgcagaaacggcaccaacagctggagagtgagagccggaccctggctgccaagatggctgccctcgcctccatggcccatggcatggccgcctccccggccatcctggaagagacccagaagcacctccggaggctggagcttctgcaggggcatctggccatccggggcctgcagctgcaggcctcagtggagctgcaccagttctgccacctgagcaacatggagctctcttgggtagccgagcacatgccccatggcagccccaccagctataccgagtgcttgaatggtgcccagagccttcaccgcaagcacaaggagctccaggtggaggtaaaagctcaccaggggcaggtgcaacgggtgctgagttctgggcggagcctggcagcctcagggcacccccaagcccaacacatcgtggagcagtgccaggagctggaaggccactgggcagagctggagagggcatgtgaagcgcgggcccagtgtctgcagcaggctgtcactttccagcagtactttctggatgtgtcagagctggagggctgggtggaggagaagcggccgctggtgagcagtcgggactatggcagagacgaggcagccaccctcaggctcattaacaagcaccaggctctacaggaggaactagccatttactggagctccatggaggagcttgaccagacggcccaaaccctcactggccccgaagtccctgagcagcagcgtgtggtgcaggagaggctccgggagcagctgcgggcactgcaggagttggcggccacacgggaccgggaactggaggggaccctgaggctgcatgagttcctgagggaggctgaggacctgcagggctggctggcaagccagaagcaggcagccaaaggaggggagagcctgggagaggaccccgagcacgccctgcacctctgcaccaagtttgcaaagtttcagcaccaagtggagatgggcagccagcgggtggccgcctgccggctgctggcggagagcctgctagagcgtgggcacagtgctggccccatggtccgtcagaggcagcaggatctgcagaccgcctggtcggagctgtgggagctgacccaggcccgaggccacgcgctccgagacaccgagaccaccctcagagttcacagagatctcttggaagtcctcacccaggtccaggagaaagccacgagcctccccaacaatgtggcacgggacctgtgtgggctggaggcgcagctgagaagccaccaggggctggagcgagaactcgtgggcaccgagcggcagctgcaggaactgctggagactgcaggcagggtgcagaagctgtgtccggggcctcaggcccatgcggtgcagcagaggcagcaagctgtgacgcaggcgtgggcagtgctgcagcgacgcatggagcagcgcagggcccagctggagcgggcacgcctcctggcccgcttccgcacggcggtgcgtgactatgcctcctgggcagcccgcgtgcgccaggacctgcaggtggaggagagttcgcaagagcctagcagtggcccgctgaagctcagtgcccaccagtggctccgggcggagctggaggcccgggagaagctgtggcagcaggccacccagctggggcagcaggcacttcttgctgcagggacacccaccaaggaggtccaggaagagcttcgagccctgcaggaccagcgggaccaggtgtatcagacctgggcacggaagcaagagaggctgcaggccgagcagcaggagcagctcttcctcagagagtgcggccgcctggaggagatcctcgcggcccaggaggtctccctgaaaaccagtgccttggggagctcggtggaagaggtagagcagttgattcgcaagcacgaggtcttcctgaaggttctgactgcccaggacaagaaggaggcagccctgcgtgagcggctgaagacgctccggcgcccccgggtgcgggaccggcttcccatcctgctgcagcgccggatgagagtgaaggagctggcggagagccggggacacgccctgcatgcctccctgctgatggccagcttcacccaggccgcaacccaggctgaggactggatccaggcgtgggcccagcagctgaaggagccggtccctcctggggacctgagagataagctgaagcccctgctgaaacaccaggcctttgaggctgaagtccaggcccatgaggaggtcatgacctctgttgccaagaagggagaggctctcctggcacagagtcaccctcgagccggagaggtctcccagcggctgcagggcctgcggaagcactgggaggacctgaggcaggcaatggccctcaggggccaggagctggaggacaggcggaacttcctggagttcctgcagagagtggaccttgcagaggcctggatccaggagaaggaggtgaagatgaatgttggtgacctgggccaggacctggagcactgcctgcagctccgacggcggctccgcgagttccgaggaaactcggccggggacacagtgggtgatgcctgcatcaggagcatcagtgacttgtcactgcagctcaagaaccgggaccctgaggaagtcaagatcatctgccagcggcgaagccagctcaacaacaggtgggcgagtttccatggcaacttgctccggtaccagcagcagctcgaaggggccttggagatacacgtgttgtcccgagagctggacaatgtcaccaagaggattcaggagaaggaagccctgatccaggccctggactgtgggaaagatctggagagcgtgcagaggctgctgcggaaacacgaggagctggagcgggaagtgcaccccatccaggcccaggtggagtccctagagcgtgaagtgggccgcctctgccaaagaagccccgaggcagcccacggcctcaggcacaggcagcaggaggtggctgagagctggtggcagctccggagcagggcccagaagcggagggaggcgctggatgccttgcaccaagctcagaaactccaggcaatgctgcaggaattgctggtcagcgcccagaggctgcgggctcagatggacacgagccccgctcctcgcagccctgtggaagcccggcgtatgttagaagagcatcaggagtgcaaggccgagctggactcctggacagacagcatcagcctggcccgaagcactgggcagcaactgctcacagcggggcaccccttcagctccgacattcgccaggtgctggctggcttagaacaggagctgagcagcctggaaggggcctggcaggagcatcagctacagctgcagcaggccctggagctacagctgtttctgagctcagtggagaagatggaacgttggctttgcagcaaggaagactccctagccagtgagggtctatgggaccccttggcccccatggagccccttctgtggaagcacaagatgctggagtgggacctggaggtgcaggcgggaaagatcagtgctctggaggccacggcccgcggcctgcaccagggtgggcaccccgaggcccagagtgccctgggcaggtgccaggccatgcttctgaggaaggaggcgctcttcaggcaagccgggacccgccgccatcgcctggaggagctccggcagctgcaggccttcctgcaggactcccaggaggtggctgcgtggctgagggagaagaacctggtggccttggaggagggtttgctggacacagccatgctgccagcacagttacagaagcagcagaatttccaggcggagctggacgcgagcatgcaccaacagcaggagctgcagcgggagggacagaggctgctgcaggggggccacccagcctcggaggccatccaggagcgactggaggagctgggagcactctggggtgagctgcaagacaactcccagaagaaggtggccaagctccagaaggcctgtgaggccctgcgtctgcggcggagcatggaggaactggagaactggctggagcccatcgaggttgagctgagagcccccactgtgggccaggccctgcctggggtgggcgagctcctgggcacacagagggagctggaggcagcagtggacaagaaggccaggcaggctgaggcactgctgggccaggcccaggcctttgtgagggaaggccactgccttgcccaagatgtggaagagcaggcccggcggctgcttcagaggttcaagagcctgagggagcccctgcaggagcgcaggacggccctggaggcccggagcctcctcttgaagttcttcagggacgccgacgaggaaatggcctgggtgcaggagaagctgcctctggccgctgcccaggactatggccagagcctgagtgcggtgcggcacctgcaggagcagcaccagaacctggagagtgagatgagcagccacgaggctctgacccgggtggtgctgggcactgggtacaagctggtgcaggctgggcactttgccgcccacgaggtggccgcccgggtgcagcagctggagaaggccatggcccacctgcgggcagaggcggcgcggaggcggcttctgctgcagcaggctcaggaggcccagcagtttctgactgagctcctggaggcgggatcctggctggctgagcggggccatgtcctggacagcgaggacatgggccacagtgctgaagccacacaggcccttctgcggcggctggaggccaccaagagagacctggaagcgttcagcccacgcatcgagcggctgcagcagacagcagcactcctggagagcaggaagaacccagaaagccccaaggtgctagcccagctgcaggcagttcgggaggcccacgcagagctgctgcggagggcggaggccagggggcacggcctgcaggagcagctgcagctacaccagctggagcgagagaccctgctcctcgacgcctggctgaccaccaaggcggccaccgccgagtcccaggactacgggcaggacctggagggtgtcaaggtgctggaagagaagtttgatgctttcagaaaggaagtgcagagcctgggccaggccaaggtgtatgccctgaggaagttggcaggcaccctggagcggggtgcacccaggcgctatccccacatccaagcccagaggagccgcattgaggctgcttgggagaggttggaccaagcaataaaagcccgcacagagaacttggctgcagcccatgaggtccacagctttcagcaggcagcagctgagctccagggaaggatgcaggagaagacggccctgatgaagggggaggacggaggccacagcctgtcatctgtgcggaccctgcagcaacagcacaggcgcctggagagagagctggaagctatggagaaggaggtggcacggctacagacggaggcctgccgactgggccagctacatcctgcagctccggggggcctggccaaggtgcaggaggcctgggccaccctgcaggcgaaggcccaggagcgaggccagtggctggcgcaggctgcacagggccatgccttcctcgggcgctgccaggaactgctagcatgggcacaggagaggcaggagctggcgtcctccgaggagctggctgaggacgtggcgggggctgagcagctccttgggcagcatgaagagctggggcaagaaatcagggagtgccgccttcaagcccaggacctgcggcaggaaggacagcagctggtggacaacagccacttcatgtctgcggaggtgacagagtgcctgcaggagctggaagggcggctgcaggagctggaggaggcttgggccctgcgctggcaacgctgtgccgagagctggggcctgcagaagcttcggcagaggctggagcaggctgaggcctggctggcctgctgggagggactcctgctgaagcccgactatgggcactcagtgtcagatgtggagttgctgctgcacagacaccaggacttagaaaagctgctggcagcccaggaagagaagtttgcccaaatgcaaaagacagagatggaacaggagctcctgctgcagccacaggagctgaagcccgggagagctggcagctcgctgacatcctttcagtggaggccctctggacaccaggggctaggagcacagctggctgagacgagggacccccaggatgcaaagggtacccccaccatggaggggtctttggagttcaagcagcacctgctgcctggcgggaggcagcctagctcgagctcctgggacagctgccgcgggaacttgcagggcagctctctgagcctgttcctggatgagaggatggcagcggagaaagtagcttccatagccctccttgacctcacgggagcccggtgtgagaggctgcggggccgccacggcaggaaacacacattctccttaaggctgaccagtggggcagagatcctgtttgcagcaccgtccgaagagcaggctgagagctggtggcgagccctgggcagcactgcagcccagagtctgagcccaaaactcaaagccaaacctgtcagctctctgaatgagtgcacgaccaaggatgcccggcctggatgtctactcaggtctgatccctgaggtgaaccccagtgcaacaccaaacttcaggggcacaagcgaggacacatctaagggaccagaataagactcagctacaggcaaaagggctccttcccgtggctgcttcaacccagttccccaggcccagcttctggaatagacagttccttctggttagatgggtcctaccatgtggcaggaaacagccattgcctggcctccccctgcattcctgtctgggtgaagaggagacgtgttacggcagagcaggtgggcaaggccagggctaccccaggcccatgtggcctcctccttgcttggaaggggtgactctgagcacaggtagacgcagacgtgtgcagagaatgtgctcttcggaggaagaacactgatgagcgagctctgtaccagcccttgccatgtacagccaagagcctagaatgacatggcccttctcagcagtaataacagatggtctcagcgcctcaca

SEQ ID NO: 185383 - DNA, 1801 bp, Homo sapiens
  Payload ID: 16505
  Gene Symbol: SPDYA
  Gene Name: speedy/RINGO cell cycle regulator family member A
  Uniprot ID: Q5MJ70
  ENST ID: ENST00000334056
  CDS Start-End: 190-1131
agcgaccgacgagcaaccgtctgaggccaggagcgctgcgacggagccttgaccgccgttgcccggccctctcccgcgcagccccgggcttccgcagtccttccttcagaagggaaatttctgagggtcaggaaggggaatctgtacctcactccttgaacaccaaggaaggaatattgggaaaccaaaatgaggcacaatcagatgtgttgtgagacaccacctactgtcactgtttatgtaaaatcagggtcaaatagatcacatcagcctaaaaagcccattactctgaagcgtcctatttgtaaagataattggcaagcatttgaaaaaaatacacataataacaacaaatctaaacgccccaaaggaccttgtctggttatacagcgtcaggatatgactgctttctttaaattatttgatgacgatttaattcaagatttcttgtggatggactgctgctgtaaaattgcagacaagtatcttttggctatgacctttgtttatttcaagagggctaaatttactataagtgagcataccaggataaatttctttattgctctgtatctggctaatacagttgaagaagatgaagaagaaaccaagtacgaaatttttccatgggctttagggaaaaactggagaaaattgttccctaatttcttaaagttaagggaccagctctgggatagaattgactatagggctattgtaagcaggcgatgttgtgaggaggttatggccattgcaccaacccattatatctggcaaagagaacgttctgttcatcacagtggagctgtcagaaactacaacagagatgaagttcagctgccccggggacctagtgccacaccagtagattgttcactctgtggtaaaaaaagaagatatgttagactgggattgtcttcatcatcatctttatccagtcatacagcaggggtgacagaaaaacattctcaggactcatacaactcactgtcaatggacataataggtgatccttctcaagcttatactggttctgaagtagtcaatgaccatcaatcaaataaaggaaagaaaactaatttcttgaagaaagacaaatctatggagtggtttacaggaagtgaagaatgagatggcccaactaaaccaatttggaatcattaactacaaaatgtcaaactaactgcaagacaagtgtcaaaatgggatgtttaagcagttttgctatgttatacatcttttagttgttattttcaaaattatatgtataagttatataagtcatagtaatagctaaaaatgccaatctatggaagcagtgattttcaatataaagttctattttgatatttttccatcttcaagtcagttactgtcatctggagtactcagttaagttgtggtttgaccttcctcaacttgacaagaaaagctaatttaagagaagaaaaacataaagtcattatattaattaaaagaaaaaacaccatttaatatgttctgaaaacattactcacctgtatgaccaggttgccagtgtactggtctagcaacatagggaaatgatccatatggaaaatcagaatgcgattcttctgttgtaaaaaaatatatgtactataagctacataaaatattttctatttttttcacaaaactgttaaaatatgagttactctctttattgtaagttttttctttatttatttccttgcatatgttttagagctactctgccagttattatacagaaactatttgtcaatgattatgtaataaacatatgattttataaccaaat

SEQ ID NO: 185384 - DNA, 1759 bp, Homo sapiens
  Payload ID: 16505
  Gene Symbol: SPDYA
  Gene Name: speedy/RINGO cell cycle regulator family member A
  Uniprot ID: Q5MJ70
  ENST ID: ENST00000379579
  CDS Start-End: 148-1089
gggagaccttagagcgggtaccgctgctggctagcgaccgacgagcaaccgtctgaggccaggagcgctgcgacggagccttgaccgccgttgcccggccctctcccgcgcagccccgggcttccgcaggaatattgggaaaccaaaatgaggcacaatcagatgtgttgtgagacaccacctactgtcactgtttatgtaaaatcagggtcaaatagatcacatcagcctaaaaagcccattactctgaagcgtcctatttgtaaagataattggcaagcatttgaaaaaaatacacataataacaacaaatctaaacgccccaaaggaccttgtctggttatacagcgtcaggatatgactgctttctttaaattatttgatgacgatttaattcaagatttcttgtggatggactgctgctgtaaaattgcagacaagtatcttttggctatgacctttgtttatttcaagagggctaaatttactataagtgagcataccaggataaatttctttattgctctgtatctggctaatacagttgaagaagatgaagaagaaaccaagtacgaaatttttccatgggctttagggaaaaactggagaaaattgttccctaatttcttaaagttaagggaccagctctgggatagaattgactatagggctattgtaagcaggcgatgttgtgaggaggttatggccattgcaccaacccattatatctggcaaagagaacgttctgttcatcacagtggagctgtcagaaactacaacagagatgaagttcagctgccccggggacctagtgccacaccagtagattgttcactctgtggtaaaaaaagaagatatgttagactgggattgtcttcatcatcatctttatccagtcatacagcaggggtgacagaaaaacattctcaggactcatacaactcactgtcaatggacataataggtgatccttctcaagcttatactggttctgaagtagtcaatgaccatcaatcaaataaaggaaagaaaactaatttcttgaagaaagacaaatctatggagtggtttacaggaagtgaagaatgagatggcccaactaaaccaatttggaatcattaactacaaaatgtcaaactaactgcaagacaagtgtcaaaatgggatgtttaagcagttttgctatgttatacatcttttagttgttattttcaaaattatatgtataagttatataagtcatagtaatagctaaaaatgccaatctatggaagcagtgattttcaatataaagttctattttgatatttttccatcttcaagtcagttactgtcatctggagtactcagttaagttgtggtttgaccttcctcaacttgacaagaaaagctaatttaagagaagaaaaacataaagtcattatattaattaaaagaaaaaacaccatttaatatgttctgaaaacattactcacctgtatgaccaggttgccagtgtactggtctagcaacatagggaaatgatccatatggaaaatcagaatgcgattcttctgttgtaaaaaaatatatgtactataagctacataaaatattttctatttttttcacaaaactgttaaaatatgagttactctctttattgtaagttttttctttatttatttccttgcatatgttttagagctactctgccagttattatacagaaactatttgtcaatgattatgtaataaacatatgattttataaccaaat

SEQ ID NO: 185385 - DNA, 755 bp, Homo sapiens
  Payload ID: 16505
  Gene Symbol: SPDYA
  Gene Name: speedy/RINGO cell cycle regulator family member A
  ENST ID: ENST00000439646
  CDS Start-End: 1-173
atctggctaatacagttgaagaagatgaagaagaaaccaagtacgaaatttttccatgggctttagggaaaaactggagaaaattgttccctaatttcttaaagttaagggaccagctctgggatagaattgactatagggctattgtaagcaggcgatgttgtgaggagtagtcaatgaccatcaatcaaataaaggaaagaaaactaatttcttgaagaaagacaaatctatggagtggtttacaggaagtgaagaatgagatggcccaactaaaccaatttggaatcattaactacaaaatgtcaaactaactgcaagacaagtgtcaaaatgggatgtttaagcagttttgctatgttatacatcttttagttgttattttcaaaattatatgtataagttatataagtcatagtaatagctaaaaatgccaatctatggaagcagtgattttcaatataaagttctattttgatatttttccatcttcaagtcagttactgtcatctggagtactcagttaagttgtggtttgaccttcctcaacttgacaagaaaagctaatttaagagaagaaaaacataaagtcattatattaattaaaagaaaaaacaccatttaatatgttctgaaaacattactcacctgtatgaccaggttgccagtgtactggtctagcaacatagggaaatgatccatatggaaaatcagaatgcgattcttctgttgtaaaaaaatatatgtactataag

SEQ ID NO: 185386 - DNA, 758 bp, Homo sapiens
  Payload ID: 16505
  Gene Symbol: SPDYA
  Gene Name: speedy/RINGO cell cycle regulator family member A
  ENST ID: ENST00000449210
  CDS Start-End: 376-758
gttgcccggccctctcccgcgcagccccgggcttccgcaggtacctgtgctcgcccccgggaaggggcctcgcaggcgaatctccagtttcgagtgtgcccggtccctgggttcgctcgccggcgaccccaccgcccgccttagatgagaaggcagcgctccagcctcgtcctcacgccgcctcccgtgggcgccctcagctgccttcgcggcgacgacacacgcgctccccgcagcgggctctgggctgagggacctggcgagggaggcagtggccgcgcagtccttccttcagaagggaaatttctgagggtcaggaaggggaatctgtacctcactccttgaacaccaaggaaggaatattgggaaaccaaaatgaggcacaatcagatgtgttgtgagacaccacctactgtcactgtttatgtaaaatcagggtcaaatagatcacatcagcctaaaaagcccattactctgaagcgtcctatttgtaaagataattggcaagcatttgaaaaaaatacacataataacaacaaatctaaacgccccaaaggaccttgtctggttatacagcgtcaggatatgactgctttctttaaattatttgatgacgatttaattcaagatttcttgtggatggactgctgctgtaaaattgcagacaagtatcttttggctatgacctttgtttatttcaagagggctaaatttactataagtgagcataccaggataaatttctttattgctctgta

SEQ ID NO: 185387 - DNA, 991 bp, Homo sapiens
  Payload ID: 16506
  Gene Symbol: SPDYC
  Gene Name: speedy/RINGO cell cycle regulator family member C
  Uniprot ID: Q5MJ68
  ENST ID: ENST00000377185
  CDS Start-End: 83-964
gaaggccctgattggtggacgggctgctttgggcagggccgccctcaggctatataagcgcactcgcggcggcgttggtgttatgctctgggccattcctgagctcgggtcaccctgccccatctccatctcctatgagatgagtgactcccaagaccccaccacttcccctgtagttaccacccaggtagagctggggggctgcagccggcaaggtgggggcaatgggttcctccgttttcgccagcaccaggaggtccaggccttcctcagccttctggaggacagttttgtccaggaattcctctccaaagacccctgcttccagatttcagataagtatctcctggccatggtgctggtctacttccagcgcgcccacctgaagctcagcgagtatacccacagcagcctgttcttggccctgtaccttgcaaacgacatggaggaggacctggagggccccaaatgtgagatttttccatgggccctgggaaaagattggtgtttacgagtggggaaattcctgcaccagagggataagctttgggcacggatgggtttccgggctgttgtgagccgccagtgctgtgaggaggtcatggcaaaggagccattccactgggcttggactcgggaccggcgcccccaccatggtggggttcagagggtctgtccacaggtccctgttcgccttccccggggccctggcctctcgccgccccactgttccccctgtggtttgccccagcactgcagcagccacttgcttaagcctgtgtcatccaagtgcccttctctgacctctgaatgtcatcgccctccctcccaaaattatctctcaagggtcaaaaacgcctggggtggggactttctcatcgtcttgcctccccagatgcaactggaaccaggcacctactccctccgcatcttcccaaagcctccggcacgccctgggcactgaagctctgcagggtgaagaacagcacgc

SEQ ID NO: 185388 - DNA, 2649 bp, Homo sapiens
  Payload ID: 16507
  Gene Symbol: SPDYE1
  Gene Name: speedy/RINGO cell cycle regulator family member E1
  Uniprot ID: Q8NFV5
  ENST ID: ENST00000258704
  CDS Start-End: 138-1148
tggggaggggaaggagcggcacatggggttgagcagaggagaaaatcagaaagatggcttagagaagtcagcagtctgcgagtctggggaggatggagagtggtttggggttttgggtcggggtctaaggtgatcagatgcagaagcattacacagtggcctggtttctttactcagcccctggggtagatcccagccccccatgtaggtcccttggctggaaaaggaagagggagtggtcagatgaatctgaggaggagccggagaaggagctcgcccctgagcctgaggagacctgggtagtggagacgctgtgtgggctcaagatgaagctgaagcaacagcgagtgtcacccatcctccttgagcaccacaaggacttcaacagtcagcttgcccctggggtagatcccagccccccgcataggtccttttgctggaaaaggaagatggagtggtgggacaaatctgaggagtcggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcctggcctgggacaaagatctgagggtgtcggacaagtatctccttgctatggtcatagcgtatttcagccgagccggcttcccctcctggcaataccaacgccttcatttcttcctggctctctacctggccaatgacatggaggaggacgacgaggactccaaacaaaacatcttccacttcctgtatgggaagaaccgctctcgcatacccttgctccgtaagcgtcggttccagttataccgttccatgaacccgagggccaggaagaaccgctctcacatacccttggtccgtaagcgtcggttccagttacgccgttgcatgaacccgagggccaggaagaaccgctctcagatagtcctgttccagaaacgtcggttccacttcttctgttccatgagctgcagggcttgggtttccccagaggagttggaggagatccaggcttatgacccagagcactgggtgtgggcgcgagatcgcgctcgcctttcctagagctccagggaccgtggaggcctgaggtcatcggcctgagagaagaacaccggacccaggggagatgtggattttcagcaggaactttattccaatgctaatggcagacaccaggaaggaggagaggaaccatttgtgcagatcatctagaagaacctggaccattcttgatggagctgaatacagtgatcacgttgtcctcctaggagcaggggtggggggagggggatggggtccttctaggagtccttggagaaaagtaagaaaccaggagtgtttccagttccaccctttcctggggcaccaccaccctttttatattgctgaattccaacctccctggggcggaacctggaggtcctgtttcttacggacttggttgccacagtccaggagcatttgaaggcacaatgcaggggctcagattggcacagaattcttttgtgaaatatcagtgccacagattgtaacagatagcttcatgcacactctgcattttattggtttgtttggaaaatgttggccattgaattattcatagatttatttcaaatagtttggaaattgttgtacttttgaaaacatgctgttcctgtagttttttgatgagagttatagttgttatatatacataaagataattttcttttcatttttgagacaattctttttatcctaaatattttatcatctttaaatttgtttctgtattattatatgtgctcctgaagcgagcactctttttatctatgatacttccataataatctcttctatttatagctattggtagttcccctaaattctgacgatagaaatttttatttgctgtttaggtttgtgactgaattgtgagaattcagttgtgatttttaacatgtgtcagatatatatactaacacgtctaatatatactattttattggtttattttgaaaaacatgggtatagaattatttaaatattattttatttatttaaatatttattaaatatatttatttatttaaatgttattattactttaaatattattttaaatattttggaaatactggtatttttgaatagatgctgtttctataaagctgtgtgatggtattataactgttatatacacatacatataattttgttttcctttttaagagaggattcttttcatcctaaatcttttacctttcaatctttgtatctattattacacgtgctgctgaagggagcatggtttttatctatgatacttagttaacatatatattacatttatagctatgtagtagttcccctaaattcttgtaaaaataaatttttatttgatatttcatctatgtttgaaatgtgagaattcagatgtaattttttaccttgatttggcatgtttgtatgttactttaaagaggatgtgtgttctaaaggaggacatgagctgtgtgttttcaagagaacaatagagtgtgtctcttggggaaacgtaataaaaatgaacttttctcacctt

SEQ ID NO: 185389 - DNA, 858 bp, Homo sapiens
  Payload ID: 16508
  Gene Symbol: SPDYE16
  Gene Name: speedy/RINGO cell cycle regulator family member E16
  ENST ID: ENST00000632150
  CDS Start-End: 1-858
atgcagaagcattacacggtggcctggtttctttactcagcccctggggtagatcccagccccccatgtaggtcccttggctggaaaaggaagaaggagtggtcagatgaatctgaggaggagccggagaaggagctcgcccctgagcctgaggagacctgggtagtggagatgctgtgtgggctcaagatgaagctgaagcaacagcgagtgtcacccatcctccctgagcaccacaaggacttcaacagtcagcttgcccctggggtagatcccagccccccgcataggtccttttgctggaaaaggaagagggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcctggcctgggacaaagatctgagggtgtcggacaagtatctcctggctatggtcatagcgtatttcagccgggccggcctcccctcctggcaataccaacgcattcatttcttcctggctctctacctggccaatgacatggaggaggacgacgaggaccccaaacaaaacatcttctacttcctgaagaaccgctctcagatagccctgttccagaaacttcggttccagttcttctgttccatgagcggcagggcttgggtttcccgggaggagttggaggagatccaggcttatgacccagagcactgggtgtgggcgcgagatcgcgctcgcctttcctag

SEQ ID NO: 185390 - DNA, 2591 bp, Homo sapiens
  Payload ID: 16508
  Gene Symbol: SPDYE16
  Gene Name: speedy/RINGO cell cycle regulator family member E16
  Uniprot ID: A6NNV3
  ENST ID: ENST00000633306
  CDS Start-End: 138-1076
tggggaggggaaggagcggcacatggggttgagcagaggagaaaatcagaaagatggcttagagaagccagcagtctgcgagtctggggaggatggagagtggtttggggttttgggtcggggtctaaggtgatcagatgcagaagcattacacggtggcctggtttctttactcagcccctggggtagatcccagccccccatgtaggtcccttggctggaaaaggaagaaggagtggtcagatgaatctgaggaggagccggagaaggagctcgcccctgagcctgaggagacctgggtagtggagatgctgtgtgggctcaagatgaagctgaagcaacagcgagtgtcacccatcctccctgagcaccacaaggacttcaacagtcagcttgcccctggggtagatcccagccccccgcataggtccttttgctggaaaaggaagagggagtggtgggacgaatctgaggagtcgttggaggaggagccacggaaggtgctcgcccctgagcctgaggagatctgggtggtggagatgctgtgtggcctcaagatgaagctgaagcgacggcgagtgtcgctcgtgctccctgagcaccacgaggccttcaacaggctgcttgaggatcctgtcattaaaagattcctggcctgggacaaagatctgagggtgtcggacaagtatctcctggctatggtcatagcgtatttcagccgggccggcctcccctcctggcaataccaacgcattcatttcttcctggctctctacctggccaatgacatggaggaggacgacgaggaccccaaacaaaacatcttctacttcctgtatgggaagacccgctctcgcatacccttggtccgtaaccgtcggttccagttatgccgttgcatgaacccgagggccaggaagaaccgctctcagatagccctgttccagaaacttcggttccagttcttctgttccatgagcggcagggcttgggtttcccgggaggagttggaggagatccaggcttatgacccagagcactgggtgtgggcgcgagatcgcgctcgcctttcctagagctccagggaccgtggaggcctgaggtcatcggcctgagagaagaacaccggacccacgggagatgtggattttcagcaggaactttattccaatgctaatggcagtcaacaggaaagaggagaggaaccatttgtgcagatcatctagaagaacctggaccattcttgatggagctgaatacagtgatcacgttgtcctcctgggagcaggggtggggggaggggggtggggtccttctaggagtccttggagaaaagtaagaaaccaggagtgtttccagttccaccctttcctgcggcaccaccaccctttttatattgctgaatgccaacctccctggggcggaacctgaggtcctgtttcttacggacttggttgccacagtccaggagcatttgaaggcacaatgcaggggctcagattggcacagaattcttttgtgaaatatcagtgccacagattgtaacagatagcttcatgcacactctgcattttattggtttgtttggaaaatgttggccattgaattattcatagatttatttcaaatagtttggaaattgttgtacttttgaaaacatgctgttcctgtagttttttgatgagagttatagttgttatatatacataaagataattttcttttcatttttaagagacaattctttttatcctaaatattttattatctttaaatttgtttctgtattattatatgtgctcctgaagtgagcactctttttatctatgatatttccataataatctcttctatttatagctattggtagttccccaccagaaaaaaacataattctggtgatagaaatttttatttgctgtttaggtctgtgactgaattgtgagaattcagttgtgatttttaacatgtctcagatatatatactaacacgtctaatatatactatctaatttattggtttattttgaaaaacatgggtatagaattatttaaatattattttatttattgaaatattaaatatatttatttatttgaatattattacttgaaatattattttaaatattttggaaatactggtatttttgaatagatgctgtttctataaagctgtgtgatgggtgttataactgttatatacacatacgtataattttgctttcctttttaagagaggattcttttcatcctaaatcttttacctttcaatctttgtatctattattacacgtgctgctgaagggagcatggtttttatctatgatacttagttaacatatatattacatttatagctatgtagtagttcccctaaattcttgtaaaaataaatttttatttgatatttcatatatgtttgaaatgtgagaattcagatgtaattttttaccttgttttggcatctttgtatgttactttaaagaggatgtgtgttctaaaggaggacatgagctgtgtgttttcaagagaacaatagagtgcgtctcttggggaaacataataaaaatgaacttttctcaccttca

SEQ ID NO: 185391 - DNA, 2598 bp, Homo sapiens
  Payload ID: 16508
  Gene Symbol: SPDYE16
  Gene Name: speedy/RINGO cell cycle regulator family member E16
  ENST ID: ENST00000632012
  CDS Start-End: 138-1076
tggggaggggaaggagcggcacatggggttgagcagaggagaaaatcagaaagatggcttagagaagccagcagtctgcgagtctggggaggatggagagtggtttggggttttgggtcggggtctaaggtgatcagatgcagaagcattacacggtggcctggtttctttactcagcccctggggtagatcccagccccccatgtaggtcccttggctggaaaaggaagaaggagtggtcagatgaatctgaggaggagccggagaaggagctcgcccctgagcctgaggagacctgggtagtggagatgctgtgtgggctcaagatgaagctgaagcaacagcgagtgtcacccatcctccctgagcaccacaaggacttcaacagtcagcttgcccctggggtagatcccagccccccgcataggtccttttgctggaaaaggaagagggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcctggcctgggacaaagatctgagggtgtcggacaagtatctcctggctatggtcatagcgtatttcagccgggccggcctcccctcctggcaataccaacgcattcatttcttcctggctctctacctggccaatgacatggaggaggacgacgaggaccccaaacaaaacatcttctacttcctgtatgggaagacccgctctcgcatacccttggtccgtaaccgtcggttccagctatgccgttgcttgaacccgagggccaggaagaaccgctctcagatagccctgttccagaaacttcggttccagttcttctgttccatgagcggcagggcttgggtttcccgggaggagttggaggagatccaggcttatgacccagagcactgggtgtgggcgcgagatcgcgctcgcctttcctagagctccagggaccgtggaggcctgaggtcatcggcctgagagaagaacaccggacccaggggagatgtggattttcagcaggaactttattccaatgctaatggcagacaacaggaaagaggagaggaaccatttgtgcagatcatctagaagaacctggaccattcttgatggagctgaatacagtgatcacgttgtcctcctgggagcaggggtggggggaggggggtggggtccttctaggagtccttggagaaaagtaagaaaccaggagtgtttccagttccaccctttcctgcggcaccaccaccctttctatattgctgaattccaacctccctgggccggaacctggaggtcctgtttcttacagacttggttgccacagtccaggagcatttgaaggcacaatgcaggggctcagattggcacagaattcttttgtgaaatatcagtgccacagattgtaacagatagcttcatgcacactctgcattttattggtttgtttggaaatgttggccattgaattattcatagatttatttcaaatagtttggaaattgttgtacttttgaaaacatgctgttcctgtagttttttgatgagagttatagttgttatatatacataaagataattttcttttcatttttaagagacaattctttttatcctaaatattttattatctttaaatttctttctgtattattatatgcgctcctgaagcgagcactctttttatctatgatacttccataaaaatctcttctatttatagctattggtagttccccaccacaaaaaaacataattctggtgatagaaatttttatttgctgtttaggtttgtgactgaattgtgagaattcagttgtgatttttaacatgtctcagatatatatactaacacgtctaatacatactatctaatttattggtttattttgaaaaacatgggtatagaattatttaaatattattttatttattgaaatatttattaaatatatttatttatttaaatattattattactttaaatattattttaaatattttggaaatactggtatttttgaatagatgctgtttctataaagctgtgtgatgggtgttataactgttatatacacatacatataattttgttttcctttttaagagaggattcttttcatcctaaatcttttacctttcaatctttgtatctattattacacgtgctgctgaagggagcatggtttttatctgtgatacttagttaacatatatattacatttatagctatgtagtagttcccctaaattcttgtaaaaataaatttttatttgatatttcatatatgtttgaaatgtgagaattcagatgtaattttttaccttgttttggcatctttgtatgttactttaaagaggatgtgtgttctaaaggaggacatgagctgtgtgttttcaagagaacaatagagtgcgtgtcttggggaaacataataaaaatgaacttttctcaccttca

SEQ ID NO: 185392 - DNA, 3434 bp, Homo sapiens
  Payload ID: 16508
  Gene Symbol: SPDYE16
  Gene Name: speedy/RINGO cell cycle regulator family member E16
  ENST ID: ENST00000632547
  CDS Start-End: 1-1059
atggacagaacggagactaggttccgtaagaggggacagattaagggaaagatcacgaccagccgtcaacctcacccccagaatgagcagagtccccagcggagcacctcggggtactccctccaggaggtggtggatgatgaagtgttgggatcatcagcccctggggtagatcccagccccccatgtaggtcccttggctggaaaaggaagaaggagtggtcagatgaatctgaggaggagccggagaaggagctcgcccctgagcctgaggagacctgggtagtggagatgctgtgtgggctcaagatgaagctgaagcaacagcgagtgtcacccatcctccctgagcaccacaaggacttcaacagtcagcttgcccctggggtagatcccagccccccgcataggtccttttgctggaaaaggaagagggagtggtgggacgaatctgaggagtcgttggaggaggagccacggaaggtgctcgcccctgagcctgaggagatctgggtggtggagatgctgtgtggcctcaagatgaagctgaagcgacggcgagtgtcgctcgtgctccctgagcaccacgaggccttcaacaggctgcttgaggatcctgtcattaaaagattcctggcctgggacaaagatctgagggtgtcggacaagtatctcctggctatggtcatagcgtatttcagccgggccggcctcccctcctggcaataccaacgcattcatttcttcctggctctctacctggccaatgacatggaggaggacgacgaggaccccaaacaaaacatcttctacttcctgtatgggaagacccgctctcgcatacccttggtccgtaaccgtcggttccagttatgccgttgcatgaacccgagggccaggaagaaccgctctcagatagccctgttccagaaacttcggttccagttcttctgttccatgagcggcagggcttgggtttcccgggaggagttggaggagatccaggcttatgacccagagcactgggtgtgggcgcgagatcgcgctcgcctttcctagagctccagggaccgtggaggcctgaggtcatcggcctgagagaaggtacatctgcatcctccggggtaaaggcagaatattggggtctattttggaaatccgaggaacccaattgcttgatccggcttcaagcctgggcaacgtggcgagattcccctctccacaaaaatacaaaaattagccaggcgacgtgggatgcatctctactcccaactactcaggaggctgaggcgggaggatcgctggagcctggaaggtcggggctgcacggagccctgatcctgccactgcactccagtctgggcgacagagtgagaccctgcctcaaaaagaatcataaatactgagtttggggaggttcattatgactgacgcacttgagttaccgatttgggtcgagggttcagtgaagctttggtttacatcttgtgcagctaaccacggtgagcacagagcatgagacttcatcatgaggaggtaggattaaggattaggcttctggactcgtggtttgtgatgttgtcacattagaaacacatctagcatggttacaagtttagatcttaagtgacacaaaaggccccagctgtgatgaagtccaaagccacattctctgagggtgccctactccctgggcagacccacccaaagtccttgctatgaagcagatcactggggctgaccttgggtgtattaagtgagttttggagtcgtggtcaccaaagtgtgagtttcacagttgaacacgatggttcagaagcagggtatagaatgaaaggcagcagataaaattgcatttctcaattgctctgaactctagacttgacatgggacgtgaataaccttcctgtctagagagctgcctccttgaagtgtgacattgtctctctcacttccagaacaccggacccacgggagatgtggattttcagcaggaactttattccaatgctaatggcagtcaacaggaaagaggagaggaaccatttgtgcagatcatctagaagaacctggaccattcttgatggagctgaatacagtgatcacgttgtcctcctgggagcaggggtggggggaggggggtggggtccttctaggagtccttggagaaaagtaagaaaccaggagtgtttccagttccaccctttcctgcggcaccaccaccctttttatattgctgaatgccaacctccctggggcggaacctgaggtcctgtttcttacggacttggttgccacagtccaggagcatttgaaggcacaatgcaggggctcagattggcacagaattcttttgtgaaatatcagtgccacagattgtaacagatagcttcatgcacactctgcattttattggtttgtttggaaaatgttggccattgaattattcatagatttatttcaaatagtttggaaattgttgtacttttgaaaacatgctgttcctgtagttttttgatgagagttatagttgttatatatacataaagataattttcttttcatttttaagagacaattctttttatcctaaatattttattatctttaaatttgtttctgtattattatatgtgctcctgaagtgagcactctttttatctatgatatttccataataatctcttctatttatagctattggtagttccccaccagaaaaaaacataattctggtgatagaaatttttatttgctgtttaggtctgtgactgaattgtgagaattcagttgtgatttttaacatgtctcagatatatatactaacacgtctaatatatactatctaatttattggtttattttgaaaaacatgggtatagaattatttaaatattattttatttattgaaatattaaatatatttatttatttgaatattattacttgaaatattattttaaatattttggaaatactggtatttttgaatagatgctgtttctataaagctgtgtgatgggtgttataactgttatatacacatacgtataattttgctttcctttttaagagaggattcttttcatcctaaatcttttacctttcaatctttgtatctattattacacgtgctgctgaagggagcatggtttttatctatgatacttagttaacatatatattacatttatagctatgtagtagttcccctaaattcttgtaaaaataaatttttatttgatatttcatatatgtttgaaatgtgagaattcagatgtaattttttaccttgttttggcatctttgtatgttactttaaagaggatgtgtgttctaaaggaggacatgagctgtgtgttttcaagagaacaatagagtgcgtctcttggggaaacataataaaaatgaacttttctcaccttcacagcaa

SEQ ID NO: 185393 - DNA, 3440 bp, Homo sapiens
  Payload ID: 16508
  Gene Symbol: SPDYE16
  Gene Name: speedy/RINGO cell cycle regulator family member E16
  ENST ID: ENST00000633523
  CDS Start-End: 1-1059
atggacagaacggagactaggttccgtaagaggggacagattaagggaaagatcacgaccagccgtcaaccgcacccccagaatgagcagagtccccagcggagcacctcggggtactccctccaggaggtggtggatgatgaagtgttgggatcatcagcccctggggtagatcccagccccccatgtaggtcccttggctggaaaaggaagaaggagtggtcagatgaatctgaggaggagccggagaaggagctcgcccctgagcctgaggagacctgggtagtggagatgctgtgtgggctcaagatgaagctgaagcaacagcgagtgtcacccatcctccctgagcaccacaaggacttcaacagtcagcttgcccctggggtagatcccagccccccgcataggtccttttgctggaaaaggaagagggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcctggcctgggacaaagatctgagggtgtcggacaagtatctcctggctatggtcatagcgtatttcagccgggccggcctcccctcctggcaataccaacgcattcatttcttcctggctctctacctggccaatgacatggaggaggacgacgaggaccccaaacaaaacatcttctacttcctgtatgggaagacccgctctcgcatacccttggtccgtaaccgtcggttccagctatgccgttgcttgaacccgagggccaggaagaaccgctctcagatagccctgttccagaaacttcggttccagttcttctgttccatgagcggcagggcttgggtttcccgggaggagttggaggagatccaggcttatgacccagagcactgggtgtgggcgcgagatcgcgctcgcctttcctagagctccagggaccgtggaggcctgaggtcatcggcctgagagaaggtacatctgcatcctccggggtaaaggcagaatattggggtctattttggaaatccgaggaacccaattgcttgatccggcttcaagcctgggcaacgtggcgagatcccctctccacaaaaatacaaaaattagccaggcgatgtgggacgcatctctactcccaactactcaggaggctgaggcgggaggatcgctggagcctggaaggttggggctgcacggagccctgatcctgccactgcactccagtctgggcgacagagtgagaccctgcctcaaaaagaatcataaatactgagtttggggaggttcattatgattgacgcacttgagttaccgatttgggtcgagggttcagtgaagctttggtttacatcttgtgcagctaaccacggtgagcacagagcatgagacttcatcatgaggaggtaggattaaggattaggcttctggactcgtggttcgtgatgttgtcacattagaaacacatctagcatggttacaagtttagatcttaagtgacacaaaaggccccagctgtgatgaagtccaaagccacattctctgagggtgccctactccctgggcagacccacccaaagtccttgctatgaagcagatcactggggctgaccttgggtgtattaagtgagttttggagtcgtggtcaccaaagtgtgagtttcacagttgaacacgatggttcagaagcagggtatagaatgaaaggcagcagataaaattgcatttctcaattgctctgaactctagacttgacatgggacgtgaataaccttcctgtctagagagctgcctccttcaagtgtgacattgtctctctcacttccagaacaccggacccaggggagatgtggattttcagcaggaactttattccaatgctaatggcagacaacaggaaagaggagaggaaccatttgtgcagatcatctagaagaacctggaccattcttgatggagctgaatacagtgatcacgttgtcctcctgggagcaggggtggggggaggggggtggggtccttctaggagtccttggagaaaagtaagaaaccaggagtgtttccagttccaccctttcctgcggcaccaccaccctttctatattgctgaattccaacctccctgggccggaacctggaggtcctgtttcttacagacttggttgccacagtccaggagcatttgaaggcacaatgcaggggctcagattggcacagaattcttttgtgaaatatcagtgccacagattgtaacagatagcttcatgcacactctgcattttattggtttgtttggaaatgttggccattgaattattcatagatttatttcaaatagtttggaaattgttgtacttttgaaaacatgctgttcctgtagttttttgatgagagttatagttgttatatatacataaagataattttcttttcatttttaagagacaattctttttatcctaaatattttattatctttaaatttctttctgtattattatatgcgctcctgaagcgagcactctttttatctatgatacttccataaaaatctcttctatttatagctattggtagttccccaccacaaaaaaacataattctggtgatagaaatttttatttgctgtttaggtttgtgactgaattgtgagaattcagttgtgatttttaacatgtctcagatatatatactaacacgtctaatacatactatctaatttattggtttattttgaaaaacatgggtatagaattatttaaatattattttatttattgaaatatttattaaatatatttatttatttaaatattattattactttaaatattattttaaatattttggaaatactggtatttttgaatagatgctgtttctataaagctgtgtgatgggtgttataactgttatatacacatacatataattttgttttcctttttaagagaggattcttttcatcctaaatcttttacctttcaatctttgtatctattattacacgtgctgctgaagggagcatggtttttatctgtgatacttagttaacatatatattacatttatagctatgtagtagttcccctaaattcttgtaaaaataaatttttatttgatatttcatatatgtttgaaatgtgagaattcagatgtaattttttaccttgttttggcatctttgtatgttactttaaagaggatgtgtgttctaaaggaggacatgagctgtgtgttttcaagagaacaatagagtgcgtgtcttggggaaacataataaaaatgaacttttctcaccttcacagcaa

SEQ ID NO: 185394 - DNA, 858 bp, Homo sapiens
  Payload ID: 16508
  Gene Symbol: SPDYE16
  Gene Name: speedy/RINGO cell cycle regulator family member E16
  ENST ID: ENST00000515340
  CDS Start-End: 1-858
atgcagaagcattacacggtggcctggtttctttactcagcccctggggtagatcccagccccccatgtaggtcccttggctggaaaaggaagaaggagtggtcagatgaatctgaggaggagccggagaaggagctcgcccctgagcctgaggagacctgggtagtggagatgctgtgtgggctcaagatgaagctgaagcaacagcgagtgtcacccatcctccctgagcaccacaaggacttcaacagtcagcttgcccctggggtagatcccagccccccgcataggtccttttgctggaaaaggaagagggagtggtgggacgaatctgaggagtcgttggaggaggagccacggaaggtgctcgcccctgagcctgaggagatctgggtggtggagatgctgtgtggcctcaagatgaagctgaagcgacggcgagtgtcgctcgtgctccctgagcaccacgaggccttcaacaggctgcttgaggatcctgtcattaaaagattcctggcctgggacaaagatctgagggtgtcggacaagtatctcctggctatggtcatagcgtatttcagccgggccggcctcccctcctggcaataccaacgcattcatttcttcctggctctctacctggccaatgacatggaggaggacgacgaggaccccaaacaaaacatcttctacttcctgaagaaccgctctcagatagccctgttccagaaacttcggttccagttcttctgttccatgagcggcagggcttgggtttcccgggaggagttggaggagatccaggcttatgacccagagcactgggtgtgggcgcgagatcgcgctcgcctttcctag

SEQ ID NO: 185395 - DNA, 1219 bp, Homo sapiens
  Payload ID: 16509
  Gene Symbol: SPDYE2
  Gene Name: speedy/RINGO cell cycle regulator family member E2
  ENST ID: ENST00000341656
  CDS Start-End: 145-921
gggaggatggagagtggtttggggttttgggtcgggctctagtgtgatcaactgcagaagcattacaccgtggcctggtttctttactcagcccctggggtagatcccagccccccgcataggtccttttgctggaaaaggaagatggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcttggcctgggacaaagatctgagggtgtcggacaagtatctcctggctatggtcatagcgtatttcagccgggccggcttcccctcctggcaataccaacgcattcatttcttcctggctctctacctggccaatgacatggaggaggacgacgaggactccaaacaaaacatcttccacttcctgtataggaagaaccgctctcgcatacccttgctccgtaagccttggttccagttaggccattccatgaacccgagggccaggaagaaccgctctcgcatacccttgctccgtaagcgtcggttccagttataccgttccacgaacccgagggccaggaagaaccgctctcgcatacccttgctccgtaagcgtcggttccagttataccgttccatgaactcgagggccaggaagaaccgctctcagatagtcctgttccagaaacgacggttccacttcttctgttccatgagctgcagggcttgggtttccccagaggagttggaggagatccaggcttatgacccagagcactgggtgtgggcgcgagatcgcgctcacctttcctagagctccagggaccggggaggcctgaggtcatcggcctgagagaagaacaccggacccaggggagatgtggattttcagcgggaactttattccaatgctaatggcagacaccaggcaggaggagaggaaccatttgtgcagatcatctagaagaacctggaccattcttgatggagctgaatacagtgatcacgttgtcctcctaggagcaggggtggggggaggggggtggggtccttctaggagtccttggagaaaagtaagaaaccaggagcgtttccagttccaccctttcctg

SEQ ID NO: 185396 - DNA, 1209 bp, Homo sapiens
  Payload ID: 16509
  Gene Symbol: SPDYE2
  Gene Name: speedy/RINGO cell cycle regulator family member E2
  Uniprot ID: Q495Y8
  ENST ID: ENST00000432940
  CDS Start-End: 1-1209
atggacagaacggagactaggttccgtaagaggggacagattacgggaaagatcacgaccagccgtcaaccgcacccccagaatgagcagagtccccagcggagcacctcggggtaccccctccaggaggtggtggatgatgaaatgttgggaccatcagcccctggggtagatcccagccccccatgtaggtcccttggctggaaaaggaagagggagtggtcagatgaatctgaggaggagccggagaaggagctcgcccctgagcctgaggagacctgggtagtggagatgctgtgtgggctcaagatgaagctgaagcaacagcgagtgtcacccatcctccctgagcaccacaaggacttcaacagtcagcttgcccctggggtagatcccagccccccgcataggtccttttgctggaaaaggaagatggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcttggcctgggacaaagatctgagggtgtcggacaagtatctcctggctatggtcatagcgtatttcagccgggccggcttcccctcctggcaataccaacgcattcatttcttcctggctctctacctggccaatgacatggaggaggacgacgaggactccaaacaaaacatcttccacttcctgtataggaagaaccgctctcgcatacccttgctccgtaagccttggttccagttaggccattccatgaacccgagggccaggaagaaccgctctcgcatacccttgctccgtaagcgtcggttccagttataccgttccacgaacccgagggccaggaagaaccgctctcgcatacccttgctccgtaagcgtcggttccagttataccgttccatgaactcgagggccaggaagaaccgctctcagatagtcctgttccagaaacgacggttccacttcttctgttccatgagctgcagggcttgggtttccccagaggagttggaggagatccaggcttatgacccagagcactgggtgtgggcgcgagatcgcgctcacctttcctag

SEQ ID NO: 185397 - DNA, 1742 bp, Homo sapiens
  Payload ID: 16509
  Gene Symbol: SPDYE2
  Gene Name: speedy/RINGO cell cycle regulator family member E2
  Uniprot ID: Q495Y8
  ENST ID: ENST00000507918
  CDS Start-End: 475-1683
agcagagacagaccccagatctgggcccaggactttgtgcagggaggggaaatactggactctgaaatgggcatgtacagagacgaagagaccccaacatgcttcaggctttgagtggagaggacacagcctctgctgggacagggaatagagggatgtggagtccctgaagatgcttttggacaatggtctgaggttgggacagtggcaggagataccattcacccaggatctccaggacaagagatcagcctggcagttacatgtgttttttttcaaactggttgccaggttggcatgaacgatgacatcagagattccgaccttcctgattggagggaccggactccgtggtgcctggagatcagttggacaacagtatcttctcagagctgttctctactcctgacttctcctaggcttgagaattgataacatactcttctggatcctagaagtgtccagaagaaggccatggacagaacggagactaggttccgtaagaggggacagattacgggaaagatcacgaccagccgtcaaccgcacccccagaatgagcagagtccccagcggagcacctcggggtaccccctccaggaggtggtggatgatgaaatgttgggaccatcagcccctggggtagatcccagccccccatgtaggtcccttggctggaaaaggaagagggagtggtcagatgaatctgaggaggagccggagaaggagctcgcccctgagcctgaggagacctgggtagtggagatgctgtgtgggctcaagatgaagctgaagcaacagcgagtgtcacccatcctccctgagcaccacaaggacttcaacagtcagcttgcccctggggtagatcccagccccccgcataggtccttttgctggaaaaggaagatggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcttggcctgggacaaagatctgagggtgtcggacaagtatctcctggctatggtcatagcgtatttcagccgggccggcttcccctcctggcaataccaacgcattcatttcttcctggctctctacctggccaatgacatggaggaggacgacgaggactccaaacaaaacatcttccacttcctgtataggaagaaccgctctcgcatacccttgctccgtaagccttggttccagttaggccattccatgaacccgagggccaggaagaaccgctctcgcatacccttgctccgtaagcgtcggttccagttataccgttccacgaacccgagggccaggaagaaccgctctcgcatacccttgctccgtaagcgtcggttccagttataccgttccatgaactcgagggccaggaagaaccgctctcagatagtcctgttccagaaacgacggttccacttcttctgttccatgagctgcagggcttgggtttccccagaggagttggaggagatccaggcttatgacccagagcactgggtgtgggcgcgagatcgcgctcacctttcctagagctccagggaccggggaggcctgaggtcatcggcctgagagaagaacaccggacccag

SEQ ID NO: 185398 - DNA, 1219 bp, Homo sapiens; identical to SEQ ID NO: 185395
  Payload ID: 16510
  Gene Symbol: SPDYE2B
  Gene Name: speedy/RINGO cell cycle regulator family member E2B
  Uniprot ID: A6NHP3
  ENST ID: ENST00000455020
  CDS Start-End: 145-921

SEQ ID NO: 185399 - DNA, 1742 bp, Homo sapiens
  Payload ID: 16510
  Gene Symbol: SPDYE2B
  Gene Name: speedy/RINGO cell cycle regulator family member E2B
  Uniprot ID: A6NHP3
  ENST ID: ENST00000507450
  CDS Start-End: 475-1683
agcagagacagaccccagatctgggcccaggactttgtgcagggaggggaaatactggactctgaaatgggcatgtacagagacgaagagaccccaacatgcttcaggctttgagtggagaggacacagcctctgctgggacagggaatagagggatgtggagtccctgaagatgcttttggacaatggtctgaggttgggacagtggcaggagataccattcacccaggatctccaggacaagagatcagcctggcagttacatgtgttttttttcaaactggttgccaggttggcatgaacgatgacatcagagattccgaccttcctgattggagggaccggactccgtggtgcctggagatcagttggacaacagtatcttctcagagctgttctctactcctgacttctcctaggcttgagaattgataacatactcttctggatcctagaagtgtccagaagaaggccatggacagaacggagactaggttccgtaagaggggacagattacgggaaagatcacgaccagccgtcaaccgcacccccagaatgagcagagtccccagcggagcacctcggggtaccccctccaggaggtggtggatgatgaaatgttgggaccatcagcccctggggtagatcccagccccccatgtaggtcccttggctggaaaaggaagagggagtggtcagatgaatctgaggaggagccggagaaggagctcgcccctgagcctgaggagacctgggtagtggagatgctgtgtgggctcaagatgaagctgaagcaacagcgagtgtcatccatcctccctgagcaccacaaggacttcaacagtcagcttgcccctggggtagatcccagccccccgcataggtccttttgctggaaaaggaagatggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcttggcctgggacaaagatctgagggtgtcggacaagtatctcctggctatggtcatagcgtatttcagccgggccggcttcccctcctggcaataccaacgcattcatttcttcctggctctctacctggccaatgacatggaggaggacgacgaggactccaaacaaaacatcttccacttcctgtataggaagaaccgctctcgcatacccttgctccgtaagccttggttccagttaggccattccatgaacccgagggccaggaagaaccgctctcgcatacccttgctccgtaagcgtcggttccagttataccgttccacgaacccgagggccaggaagaaccgctctcgcatacccttgctccgtaagcgtcggttccagttataccgttccatgaactcgagggccaggaagaaccgctctcagatagtcctgttccagaaacgacggttccacttcttctgttccatgagctgcagggcttgggtttccccagaggagttggaggagatccaggcttatgacccagagcactgggtgtgggcgcgagatcgcgctcacctttcctagagctccagggaccggggaggcctgaggtcatcggcctgagagaagaacaccggacccag

SEQ ID NO: 185400 - DNA, 1209 bp, Homo sapiens
  Payload ID: 16510
  Gene Symbol: SPDYE2B
  Gene Name: speedy/RINGO cell cycle regulator family member E2B
  Uniprot ID: A6NHP3
  ENST ID: ENST00000436228
  CDS Start-End: 1-1209
atggacagaacggagactaggttccgtaagaggggacagattacgggaaagatcacgaccagccgtcaaccgcacccccagaatgagcagagtccccagcggagcacctcggggtaccccctccaggaggtggtggatgatgaaatgttgggaccatcagcccctggggtagatcccagccccccatgtaggtcccttggctggaaaaggaagagggagtggtcagatgaatctgaggaggagccggagaaggagctcgcccctgagcctgaggagacctgggtagtggagatgctgtgtgggctcaagatgaagctgaagcaacagcgagtgtcatccatcctccctgagcaccacaaggacttcaacagtcagcttgcccctggggtagatcccagccccccgcataggtccttttgctggaaaaggaagatggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcttggcctgggacaaagatctgagggtgtcggacaagtatctcctggctatggtcatagcgtatttcagccgggccggcttcccctcctggcaataccaacgcattcatttcttcctggctctctacctggccaatgacatggaggaggacgacgaggactccaaacaaaacatcttccacttcctgtataggaagaaccgctctcgcatacccttgctccgtaagccttggttccagttaggccattccatgaacccgagggccaggaagaaccgctctcgcatacccttgctccgtaagcgtcggttccagttataccgttccacgaacccgagggccaggaagaaccgctctcgcatacccttgctccgtaagcgtcggttccagttataccgttccatgaactcgagggccaggaagaaccgctctcagatagtcctgttccagaaacgacggttccacttcttctgttccatgagctgcagggcttgggtttccccagaggagttggaggagatccaggcttatgacccagagcactgggtgtgggcgcgagatcgcgctcacctttcctag

SEQ ID NO: 185401 - DNA, 3185 bp, Homo sapiens
  Payload ID: 16511
  Gene Symbol: SPDYE3
  Gene Name: speedy/RINGO cell cycle regulator family member E3
  Uniprot ID: A6NKU9
  ENST ID: ENST00000332397
  CDS Start-End: 185-1834
ctctgtcggcgcctggcagttcaggtgaacaacagtaacttctcagagctgttctccactcctgacttctcccagcctcgagaattgataacacactcttctggatcccagcagtgtccagaagaagaccaaggacagaacagagactagcttcggtgagattggacagattttgggaaagatcatgacgagccatcaaccgcagccccaggaagagcagagcccccagcggagcacctcagggtaccccctccaggaggtggtggatgatgaagtgtcgggaccatcagcccctggggtagatcccagccccccacgtaggtcccttggctgcaaaaggaagagggagtgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgcccctggggtagatcccagccccccacgtaggtcccttggctgcaaaaggaagagggagtgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgcccctggggtagatcccagccccccacgtaggtcccttggctgcaaaaggaagagggagtgtttggatgaatctgatgatgagccagagaaggagctcgcccctgagcctgaggagacctgggtggcagagacgctgtgtggcctcaagatgaaggcgaagcgacggcgagtgtcgctcgtgctccctgagtactacgaggccttcaacaggctgcttgcccctggggtagatcccagccccccacgtaggtcccttggctgcaaaaggaagagggagtgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgcccctggggtagatcccagccccccgcgtaggtcccttggctgcaaaaggaagagggagtgtttggatgaatctgatgatgagccagagaaggagctcgcccctgagcctgaggagacctgggtggcggagacgctgtgtggcctcaagatgaaggcgaagcgacggcgagtgtcgctcgtgctccctgagtactacgaggccttcaacaggctgcttgaggatcctgtcattaaaagattcctggcctgggacaaagatctgagggtgtcagacaagtatctcctggctatggtcatagcgtatttcagccgggccggcctcccctcctggcaataccaacgcattcatttcttcctggctctctatctggccaatgacatggaggaggacgacgaggcccccaaacaaaagatcttctacttcctgtacgggaagacccactctcacatacccttgcgccctaagcattggttccagttatgccgtcccatgaacccgagggccaggaagaactgctctcagatagccttgttccagaagcgtcggttccagttcttctgttccatgcgctgcagggcttgggtttccccggaggagttggaggagatccaggcttatgacccagagcactgggtgtgggcgcgagatcgcgcccacctttcctagagctccagggaccgtggaggcctgaggtcatcggcctgagagaagaacaccggacccaggggagatgtggattttcagcaggaactttattccagtgctaatggcagacatcaggaaggaggagaggagccatttgtgcagatcatctagaagaacctggaccattcttgacagagctgaatacagtgatcacgttgtcctccaaggagcaggggtggggtggggtacttctaggagtccttggagaaaagtaagaaaccaggagtgtttccagttccaccctttcctgcggcaccacctccctttttatattgctgaatgccaacctccctggggcggaacctggaggtcctgtttcttacggacttggttgccacagtccaggagcatttgaaggcacagtgcaggggctcagattggcacagaattctttgtgaaatatgagtgccacagactgtaacagatagcttcatgcacactatgcattttattggtttgtttggaaaatgttggccattgaatcattaataggtttatttcaaatagtttggaaattgttgtacttttgaaaacatgctgttcctgtagagttttttgatgagagttatagttgttatatatacataaagataattttcttttcatttttaagtgagaattctttttatcctaaatcttttattatctttaaatttttctctgtattattatatgtgctcctgaagcgagcactctttttatctatgatacttccataataatctcttctatttatagctattggtagttcccccaaattctggtcatagaaatttttatttgctgtttaggtttgtgactgaattgtgagaattcagttgtgatttttaacatgtcttagatatatatactaacatgtctaatatatactatctattttattgatttatttcgaaaaagatgggcaaagaattatttaaatattattttatttatttaaatatttattaaatatatttatttatttaaatatttattaaatatatttatttatttaaatgttattactttaaatattattttaaatattttggaaatactggtatttttgaatagatgctgtttctataaagctgtgtgatgggtattataactgttatatacacataaatataattttgttttcctttttaagagaggattctttttatcctaaatcttttacctttcaatctttgtatctattactacatatgctgctgaagggagcagactttttatctatgatacttagttaatgtatatattacatttatagctatgtggtagttcccctaaattcttgtaaaaataaatttttatttgatattta

SEQ ID NO: 185402 - DNA, 923 bp, Homo sapiens
  Payload ID: 16512
  Gene Symbol: SPDYE4
  Gene Name: speedy/RINGO cell cycle regulator family member E4
  Uniprot ID: A6NLX3
  ENST ID: ENST00000328794
  CDS Start-End: 178-891
tgcttgggagttcaggtggacaacagcaacttctcagaactactcttcactcctaacttctcccgagcctctagaagagaaacgcactcttctgggtcctaacggagtctggaagaaggctttggacagaacagggactaggttttgtggacagaaacaaagtgtttgggagagattatggccagtggtcaagcgcgccccccgtttgaggaggagagcccccagcctagcacaacggtacggtcccccgaggtggtggtggatgatgaagtgccaggaccatcagccccttggatagatcccagcccccagcctcaatcccttggcctgaaaaggaagagcgaatggtcagacgaatccgaggaggagctggaggaggagctggagttggagcgcgcccctgagcccgaggacacctgggtggtggagacgctgtgtgggctcaagatgaagctgaagcgaaagcgagcatcctccgtgctccctgagcaccacgaggccttcaacaggctccttggggatcctgtcgttcaaaaattcctggcctgggacaaagacctgagggtgtcagacaagtatctcctggctatggtcatagcgtattttagccgtgccggcctcttctcgtggcaataccaacgcattcatttcttcctggctctctacctggccagtgacatggaggaggacaaccaggccccgaaacaagacatcttctccttcctctacgggaagaactactcccagcgacccttgttccataagcttcgataccagctcctctgttccatgcgctggaggacgtgggtttccccagaggagatggaggagatccaggcttatgacccagagcactgggtgtgggcccgagatcgcaccctcatttcctagagctccggggacatggaggcctgaggtcatcg

SEQ ID NO: 185403 - DNA, 406 bp, Homo sapiens
  Payload ID: 16512
  Gene Symbol: SPDYE4
  Gene Name: speedy/RINGO cell cycle regulator family member E4
  ENST ID: ENST00000580999
  CDS Start-End: 1-275
agcgcgcccctgagcccgaggacacctgggtggtggagacgctgtgtgggctcaagatgaagctgaagcgaaagcgagcatcctccgtgctccctgagcaccacgaggccttcaacaggctccttggggatcctgtcgttcaaaaattcctggcctgggacaaagacctgagggtgtcagacaagtatctcctggctatggtcatagcgtattttagccgtgccggcctcttctcgtggcaataccaacgcattcatttcttcctggctctgtgagtagtttgcttcttcccatctgtcaatatccaacaccctgggacagtggacgaagtgggattccaaccttccatctatttttttaccctacttctcctctttactctgtatataaaaacgataagattata

SEQ ID NO: 185404 - DNA, 928 bp, Homo sapiens
  Payload ID: 16512
  Gene Symbol: SPDYE4
  Gene Name: speedy/RINGO cell cycle regulator family member E4
  ENST ID: ENST00000582989
  CDS Start-End: 178-303
tgcttgggagttcaggtggacaacagcaacttctcagaactactcttcactcctaacttctcccgagcctctagaagagaaacgcactcttctgggtcctaacggagtctggaagaaggctttggacagaacagggactaggttttgtggacagaaacaaagtgtttgggagagattatggccagtggtcaagcgcgccccccgtttgaggaggagagcccccagcctagcacaacggtacggtcccccgaggtggtggtggatgatgaagtgccaggaccatcaggtgagccccttggatagatcccagcccccagcctcaatcccttggcctgaaaaggaagagcgaatggtcagacgaatccgaggaggagctggaggaggagctggagttggagcgcgcccctgagcccgaggacacctgggtggtggagacgctgtgtgggctcaagatgaagctgaagcgaaagcgagcatcctccgtgctccctgagcaccacgaggccttcaacaggctccttggggatcctgtcgttcaaaaattcctggcctgggacaaagacctgagggtgtcagacaagtatctcctggctatggtcatagcgtattttagccgtgccggcctcttctcgtggcaataccaacgcattcatttcttcctggctctctacctggccagtgacatggaggaggacaaccaggccccgaaacaagacatcttctccttcctctacgggaagaactactcccagcgacccttgttccataagcttcgataccagctcctctgttccatgcgctggaggacgtgggtttccccagaggagatggaggagatccaggcttatgacccagagcactgggtgtgggcccgagatcgcaccctcatttcctagagctccggggacatggaggcctgaggtcatcg

SEQ ID NO: 185405 - DNA, 1700 bp, Homo sapiens
  Payload ID: 16513
  Gene Symbol: SPDYE5
  Gene Name: speedy/RINGO cell cycle regulator family member E5
  ENST ID: ENST00000625065
  CDS Start-End: 424-1632
agactggactctgaaatgggcatgtacagagacaaagagaccccaacatgcttcaggctttgagtggagaggacacagcctctgctgggacagggaacagagggatgtggagtccctgaagatgcttttggacaatggtctgaggttgggacagtggcaggagataccattcacccaggatctccaggacaagagatcagcctggcagttacatgtgttttttttcaaactggttgccaggttggcatgagcgatgacatcagagattccgaccatcctgattggagggaccggactccgtggtgcctggagatcagttggacaacagtatcttctcagagctgttctccactcctgacttctcctaggcttgagaattgataacatactcttctggatcctagcagtgatcagaagaaggccatggacagaacggagactaggttccgtaagaggggacagattacggaaaagatcacgaccagccgtcaaccgcaaccccagaatgagcagagtccccagcggagcacctcggggtaccccctccaggaggtggtggatgatgaagtgttgggaccatcagcccctggggtagatcccagccccccatgtaggtcccttggctggaaaaggaagagggagtggtcagatgaatctgcggaggagccggagaaggagctcgcccctgaacctgaggagacctgggtagtggagatgctgtgtgggctcaagatgaagctgaagcaacagcgagtgtcacccatcctccctgagcaccacaagggcttcaacagtcagcttgcccctggggtagatcccagccccccgcataggtccttttgctggaaaaggaagatggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcctggcctgggacaaagatctgagggtgtcggacaagtatctcctggctatggtcatagcgtatttcagccgggccggcttcccctcctggcaataccaacgcattcatttcttcctggctctctacctggccaatgacatggaggaggacgacgaggactccaaacaaaacatcttccacttcctgtatgggaagaaccgctctcgcatacccttgctccgtaagcgttggttccagttaggccgttccatgaacccgagggccaggaagaagcgctctcgcatacccttgctccgtaagcgtcggttccagttaggccgttccatgaacccgagggccaggaagaaccgctctcgcatacccttgctccgtaagcgtcggttccagttaggccgttccatgaacctgagggccaggaagaaccgctctcagatagtcctgttccagaaacgtcggttccagttcttctgttccatgagcggcagggcttgggtttccccggaggagttggaggagatccaggcttatgacccagagcactgggtgtgggcgcgagatcgcgctcacctttcctagagctccagggaccgtggaggcctgaggtcatcggcctgagagaagaacaccggacccaggggagatgt

SEQ ID NO: 185406 - DNA, 2667 bp, Homo sapiens
  Payload ID: 16513
  Gene Symbol: SPDYE5
  Gene Name: speedy/RINGO cell cycle regulator family member E5
  ENST ID: ENST00000624640
  CDS Start-End: 137-1150
ggggaggggaaggagcggcacatggggttgagcagaggagaaaatcagaaagatggcttagagaagccagcagtctgcgagtctggggaggatggagagtggtttggggttttgggtcggggtctaaggtgatcagatgcagaagcattacacggtggcctggtttctttactcagcccctggggtagatcccagccccccatgtaggtcccttggctggaaaaggaagagggagtggtcagatgaatctgcggaggagccggagaaggagctcgcccctgaacctgaggagacctgggtagtggagatgctgtgtgggctcaagatgaagctgaagcaacagcgagtgtcacccatcctccctgagcaccacaagggcttcaacagtcagcttgcccctggggtagatcccagccccccgcataggtccttttgctggaaaaggaagatggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcctggcctgggacaaagatctgagggtgtcggacaagtatctcctggctatggtcatagcgtatttcagccgggccggcttcccctcctggcaataccaacgcattcatttcttcctggctctctacctggccaatgacatggaggaggacgacgaggactccaaacaaaacatcttccacttcctgtatgggaagaaccgctctcgcatacccttgctccgtaagcgttggttccagttaggccgttccatgaacccgagggccaggaagaaccgctctcgcatacccttgctccgtaagcgtcggttccagttaggccgttccatgaacctgagggccaggaagaaccgctctcagatagtcctgttccagaaacgtcggttccagttcttctgttccatgagcggcagggcttgggtttccccggaggagttggaggagatccaggcttatgacccagagcactgggtgtgggcgcgagatcgcgctcacctttcctagagctccagggaccgtggaggcctgaggtcatcggcctgagagaagaacaccggacccaggggagatgtggattttcagcaggaactttattccaatgctaatggcagacaccaggaaggaggagaggaaccatttgtgcagatcatctagaagaacctggaccattcttgatggagctgaatacagtgatcacgttgtcctcctaggagcaggggtggggggaggggggtggggtccttctaggagtccttggagaaaagtaagaaaccaggagtgtttccagttccaccctttcctgcagcaccaccaccctttctatattgctgaattccaacctccctggggcggaacctggaggtcctgtttcttatggacttggttaccacagtccagaagcatttgaaggcacaatgcaggggctcagattggcacagatttcttctgtgaaatatcagtgccacagattgtaacagatagcttcatgcacactctgcattttattggtttgtttggaaaatgttggccattgaattattcatagatttatttcaaatagtttggaaattgttgtacttttgaaaacatgctgttcctgtagttttttgatgagagttatagttgttatatatacataaagataattttcttttcatttttaagagacaattctttttatcctaaatattttattatctttaaatttctttctgtattattatatgtgctcctgaagcgagcactctttttatctatgatacttccataataatctcttctatttatagctattggtagttccccaccacaaaaaaaacataattctggtgatagaaatttttatttgctgtttaggtttgtgactgaattgtgagaattcagttgtgatttttaacatgtctcagatatatatactaacacgtctaatatatactatctattttattggtttattttgaaaaacatgggtatagaattatttaaatattattttatttattgaaatatttattaaatatatttatttaaatattattacttgaaatattattttaaatatttttgaaatactgctatttttgaatagatgctgtttctataaagctgtgtgatgggtgttataactgttatatacacatacgtataattttgctttcctttttaagagaggattcttttcatcctaaatcttttacctttcaatctttgtatctattattacacgtgttgctgaagggagcatggtttttatctgtgatacttagttaacatatatattacatttatagctatgtagtagttcccctaaattcttgtaaaaataaatttttatttgatatttcatatatgtttgaaatgtgagaattcaggtgtaattttttaccttgttttggcatgtttgtatgttactttaaagaggatgtgtgttctaaaggaggacatgagctgtgtgttttcaagagaacaatagagtgcgtctcttggggaaacataataaaaatgaacttttctcaccttca

SEQ ID NO: 185407 - DNA, 1209 bp, Homo sapiens
  Payload ID: 16513
  Gene Symbol: SPDYE5
  Gene Name: speedy/RINGO cell cycle regulator family member E5
  ENST ID: ENST00000455862
  CDS Start-End: 1-1209
atggacagaacggagactaggttccgtaagaggggacagattacggaaaagatcacgaccagccgtcaaccgcaaccccagaatgagcagagtccccagcggagcacctcggggtaccccctccaggaggtggtggatgatgaagtgttgggaccatcagcccctggggtagatcccagccccccatgtaggtcccttggctggaaaaggaagagggagtggtcagatgaatctgcggaggagccggagaaggagctcgcccctgaacctgaggagacctgggtagtggagatgctgtgtgggctcaagatgaagctgaagcaacagcgagtgtcacccatcctccctgagcaccacaagggcttcaacagtcagcttgcccctggggtagatcccagccccccgcataggtccttttgctggaaaaggaagatggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcctggcctgggacaaagatctgagggtgtcggacaagtatctcctggctatggtcatagcgtatttcagccgggccggcttcccctcctggcaataccaacgcattcatttcttcctggctctctacctggccaatgacatggaggaggacgacgaggactccaaacaaaacatcttccacttcctgtatgggaagaaccgctctcgcatacccttgctccgtaagcgttggttccagttaggccgttccatgaacccgagggccaggaagaagcgctctcgcatacccttgctccgtaagcgtcggttccagttaggccgttccatgaacccgagggccaggaagaaccgctctcgcatacccttgctccgtaagcgtcggttccagttaggccgttccatgaacctgagggccaggaagaaccgctctcagatagtcctgttccagaaacgtcggttccagttcttctgttccatgagcggcagggcttgggtttccccggaggagttggaggagatccaggcttatgacccagagcactgggtgtgggcgcgagatcgcgctcacctttcctag

SEQ ID NO: 185408 - DNA, 1691 bp, Homo sapiens
  Payload ID: 16514
  Gene Symbol: SPDYE6
  Gene Name: speedy/RINGO cell cycle regulator family member E6
  ENST ID: ENST00000563237
  CDS Start-End: 422-1630
actggactctgaaatgggcatgtacagagacgaagagaccccaacatgcttcaggctttgagtggagaggacacagcctctgctgggacagggaatagagggatgtggagtccctgaagatgcttttggacaatggtctgaggttgggacagtggcaggagataccattcacccaggatctccaggacaagagatcagcctggcagttacatgtgttttttttcaaactggttgccaggttggcatgaacgatgacatcagagattccgaccttcctgattggagggaccggactccgtggtgcctggagatcagttggacaacagtatcttctcagagctgttctctactcctgacttctcctaggcttgagaattgataacatactcttctggatcctagaagtgtccagaagaaggccatggacagaacggagactaggttccgtaagaggggacagattacgggaaagatcacgaccagccgtcaaccgcacccccagaatgagcagagtccccagcggagcacctcggggtaccccctccaggaggtggtggatgatgaaatgttgggaccatcagcccctggggtagatcccagccccccatgtaggtcccttggctggaaaaggaagagggagtggtcagatgaatctgaggaggagccggagaaggagctcgcccctgagcctgaggagacctgggtagtggagatgctgtgtgggctcaagatgaagctgaagcaacagcgagtgtcatccatcctccctgagcaccacaaggacttcaacagtcagcttgcccctggggtagatcccagccccccgcataggtccttttgctggaaaaggaagatggagtggtgggacgaatctgaggagtcgttggaggaggagccacggaaggtgctcgcccctgagcctgaggagatctgggtggcggagatgctgtgtggcctcaagatgaagctgaagcgacggcgagtgtcgctcgtgctccctgagcaccacgaggccttcaacaggctgcttgaggatcctgtcattaaaagattcttggcctgggacaaagatctgagggtgtcggacaagtatctcctggctatggtcatagcgtatttcagccgggctggcttcccctcctggcaataccaacgcattcatttcttcctggctctctacctggccaatgacatggaggaggacgacgaggactccaaacaaaacatcttccacttcctgtataggaagaaccgctctcgcatacccttgctccgtaagcgttggttccagttaggccattccatgaacccgagggccaggaagaaccgctctcgcatacccttgctccgtaagcgtcggttccagttataccgttccacgaacccgagggccaggaagaaccgctctcgcatacccttgctccgtaagcatcggttccagttataccgttccatgaactcgagggccaggaagaaccgctctcagatagtcctgttccagaaacgacggttccacttcttctgttccatgagctgcagggcttgggtttccccagaggagttggaggagatccaggcttatgacccagagcactgggtgtgggcgcgagatcgcgctcacctttcctagagctccagggaccggggaggcctgaggtcatcggcctgagagaagaacaccggacccaggg

SEQ ID NO: 185409 - DNA, 10782 bp, Homo sapiens
  Payload ID: 16515
  Gene Symbol: SPEG
  Gene Name: SPEG complex locus
  Uniprot ID: Q15772
  ENST ID: ENST00000312358
  CDS Start-End: 133-9936
acaggccgaaggcgggcgggcagcaggaaggcaggccgccggccccccagacttgtctcctagggcaccgtcccgcgggtgcccccgtggccgcccagttccggcgtccccccagcccagctctcagtggccatgcagaaagcccggggcacgcgaggcgaggatgcgggcacgagggcaccccccagccccggagtgcccccgaaaagggccaaggtgggggccggcggcggggctcctgtggccgtggccggggcgccagtcttcctgcggcccctgaagaacgcggcggtgtgcgcgggcagcgacgtgcggctgcgggtggtggtgagcgggacgccccagcccagcctccgctggttccgggatgggcagctcctgcccgcgccggcccccgagcccagctgcctgtggctgcggcgctgcggggcgcaggacgccggcgtgtacagctgcatggcccagaacgagcggggccgggcctcctgcgaggcggtgctcacagtgctggaggtcggagactcagagacggctgaggatgacatcagcgatgtgcagggaacccagcgcctggagcttcgggatgacggggccttcagcacccccacggggggttctgacaccctggtgggcacctccctggacacacccccgacctccgtgacaggcacctcagaggagcaagtgagctggtggggcagcgggcagacggtcctggagcaggaagcgggcagtgggggtggcacccgccgcctcccgggcagcccaaggcaagcacaggcaaccggggccgggccacggcacctgggggtggagccgctggtgcgggcatctcgagctaatctggtgggcgcaagctgggggtcagaggatagcctttccgtggccagtgacctgtacggcagcgcattcagcctgtacagaggacgggcgctctctatccacgtcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcgcactcaggagcctgtgctgcccgaggacaccaccaccgaagagaagcgagggaagaagtccaagtcgtccgggccctccctggcgggcaccgcggaatcccgaccccagacgccactgagcgaggcctcaggccgcctgtcggcgttgggccgatcgcctaggctggtgcgcgccggctcccgcatcctggacaagctgcagttcttcgaggagcgacggcgcagcctggagcgcagcgactcgccgccggcgcccctgcggccctgggtgcccctgcgcaaggcccgctctctggagcagcccaagtcggagcgcggcgcaccgtggggcacccccggggcctcgcaggaagaactgcgggcgccaggcagcgtggccgagcggcgccgcctgttccagcagaaagcggcctcgctggacgagcgcacgcgtcagcgcagcccggcctcagacctcgagctgcgcttcgcccaggagctgggccgcatccgccgctccacgtcgcgggaggagctggtgcgctcgcacgagtccctgcgcgccacgctgcagcgtgccccatcccctcgagagcccggcgagcccccgctcttctctcggccctccacccccaagacatcgcgggccgtgagccccgccgccgcccagccgccctctccgagcagcgcggagaagccgggggacgagcctgggaggcccaggagccgcgggccggcgggcaggacagagccgggggaaggcccgcagcaggaggttaggcgtcgggaccaattcccgctgacccggagcagagccatccaggagtgcaggagccctgtgccgccccccgccgccgatcccccagaggccaggacgaaagcaccccccggtcggaagcgggagcccccggcgcaggccgtgcgcttcctgccctgggccacgccgggcctggagggcgctgctgtaccccagaccttggagaagaacagggcggggcctgaggcagagaagaggcttcgcagagggccggaggaggacggtccctgggggccctgggaccgccgaggggcccgcagccagggcaaaggtcgccgggcccggcccacctcccctgagctcgagtcttcggatgactcctacgtgtccgctggagaagagcccctagaggcccctgtgtttgagatccccctgcagaatgtggtggtggcaccaggggcagatgtgctgctcaagtgtatcatcactgccaaccccccgccccaagtgtcctggcacaaggatgggtcagcgctgcgcagcgagggccgcctcctcctccgggctgagggtgagcggcacaccctgctgctcagggaggccagggcagcagatgccgggagctatatggccaccgccaccaacgagctgggccaggccacctgtgccgcctcactgaccgtgagacccggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgagcacaccctgaaagccggtccctggccgtgctggcccccctgcaggacgtggacgtgggggccggggagatggcgctgtttgagtgcctggtggcggggcccactgacgtggaggtggattggctgtgccgtggccgcctgctgcagcctgcactgctcaaatgcaagatgcatttcgatggccgcaaatgcaagctgctacttacatctgtacatgaggacgacagtggcgtctacacctgcaagctcagcacggccaaagatgagctgacctgcagtgcccggctgaccgtgcggccctcgttggcacccctgttcacacggctgctggaagatgtggaggtgttggagggccgagctgcccgtttcgactgcaagatcagtggcaccccgccccctgttgttacctggactcattttggctgccccatggaggagagtgagaacttgcggctgcggcaggacgggggtctgcactcactgcacattgcccatgtgggcagcgaggacgaggggctctatgcggtcagtgctgttaacacccatggccaggcccactgctcagcccagctgtatgtagaagagccccggacagccgcctcaggccccagctcgaagctggagaagatgccatccattcccgaggagccagagcagggtgagctggagcggctgtccattcctgacttcctgcggccactgcaggacctggaggtgggactggccaaggaggccatgctagagtgccaggtgaccggcctgccctaccccaccatcagctggttccacaatggccaccgcatccagagcagcgacgaccggcgcatgacacagtacagggatgtccatcgcttggtgttccctgccgtggggcctcagcacgccggtgtctacaagagcgtcattgccaacaagctgggcaaagctgcctgctatgcccacctgtatgtcacagatgtggtcccaggccctccagatggcgccccgcaggtggtggctgtgacggggaggatggtcacactcacatggaacccccccaggagtctggacatggccatcgacccggactccctgacgtacacagtgcagcaccaggtgctgggctcggaccagtggacggcactggtcacaggcctgcgggagccagggtgggcagccacagggctgcgtaagggggtccagcacatcttccgggtcctcagcaccactgtcaagagcagcagcaagccctcacccccttctgagcctgtgcagctgctggagcacggcccaaccctggaggaggcccctgccatgctggacaaaccagacatcgtgtatgtggtggagggacagcctgccagcgtcaccgtcacattcaaccatgtggaggcccaggtcgtctggaggagctgccgaggggccctcctagaggcacgggccggtgtgtacgagctgagccagccagatgatgaccagtactgtcttcggatctgccgggtgagccgccgggacatgggggccctcacctgcaccgcccgaaaccgtcacggcacacagacctgctcggtcacattggagctggcagaggcccctcggtttgagtccatcatggaggacgtggaggtgggggctggggaaactgctcgctttgcggtggtggtcgagggaaaaccactgccggacatcatgtggtacaaggacgaggtgctgctgaccgagagcagccatgtgagcttcgtgtacgaggagaatgagtgctccctggtggtgctcagcacgggggcccaggatggaggcgtctacacctgcaccgcccagaacctggcgggtgaggtctcctgcaaagcagagttggctgtgcattcagctcagacagctatggaggtcgagggggtcggggaggatgaggaccatcgaggaaggagactcagcgacttttatgacatccaccaggagatcggcaggggtgctttctcctacttgcggcgcatagtggagcgtagctccggcctggagtttgcggccaagttcatccccagccaggccaagccaaaggcatcagcgcgtcgggaggcccggctgctggccaggctccagcacgactgtgtcctctacttccatgaggccttcgagaggcgccggggactggtcattgtcaccgagctctgcacagaggagctgctggagcgaatcgccaggaaacccaccgtgtgtgagtctgagatccgggcctatatgcggcaggtgctagagggaatacactacctgcaccagagccacgtgctgcacctcgatgtcaagcctgagaacctgctggtgtgggatggtgctgcgggcgagcagcaggtgcggatctgtgactttgggaatgcccaggagctgactccaggagagccccagtactgccagtatggcacacctgagtttgtagcacccgagattgtcaatcagagccccgtgtctggagtcactgacatctggcctgtgggtgttgttgccttcctctgtctgacaggaatctccccgtttgttggggaaaatgaccggacaacattgatgaacatccgaaactacaacgtggccttcgaggagaccacattcctgagcctgagcagggaggcccggggcttcctcatcaaagtgttggtgcaggaccggctgagacctaccgcagaagagaccctagaacatccttggttcaaaactcaggcaaagggcgcagaggtgagcacggatcacctgaagctattcctctcccggcggaggtggcagcgctcccagatcagctacaaatgccacctggtgctgcgccccatccccgagctgctgcgggcccccccagagcgggtgtgggtgaccatgcccagaaggccaccccccagtggggggctctcatcctcctcggattctgaagaggaagagctggaagagctgccctcagtgccccgcccactgcagcccgagttctctggctcccgggtgtccctcacagacattcccactgaggatgaggccctggggaccccagagactggggctgccacccccatggactggcaggagcagggaagggctccctctcaggaccaggaggctcccagcccagaggccctcccctccccaggccaggagcccgcagctggggctagccccaggcggggagagctccgcaggggcagctcggctgagagcgccctgccccgggccgggccgcgggagctgggccggggcctgcacaaggcggcgtctgtggagctgccgcagcgccggagccccagcccgggagccacccgcctggcccggggaggcctgggtgagggcgagtatgcccagaggctgcaggccctgcgccagcggctgctgcggggaggccccgaggatggcaaggtcagcggcctcaggggtcccctgctggagagcctggggggccgtgctcgggacccccggatggcacgagctgcctccagcgaggcagcgccccaccaccagcccccactcgagaaccggggcctgcaaaagagcagcagcttctcccagggtgaggcggagccccggggccggcaccgccgagcgggggcgcccctcgagatccccgtggccaggcttggggcccgtaggctacaggagtctccttccctgtctgccctcagcgaggcccagccatccagccctgcacggcccagcgcccccaaacccagtacccctaagtctgcagaaccttctgccaccacacctagtgatgctccgcagccccccgcaccccagcctgcccaagacaaggctccagagcccaggccagaaccagtccgagcctccaagcctgcaccacccccccaggccctgcaaaccctagcgctgcccctcacaccctatgctcagatcattcagtccctccagctgtcaggccacgcccagggcccctcgcagggccctgccgcgccgccttcagagcccaagccccacgctgctgtctttgccagggtggcctccccacctccgggagcccccgagaagcgcgtgccctcagccgggggtcccccggtgctagccgagaaagcccgagttcccacggtgccccccaggccaggcagcagtctcagtagcagcatcgaaaacttggagtcggaggccgtgttcgaggccaagttcaagcgcagccgcgagtcgcccctgtcgctggggctgcggctgctgagccgttcgcgctcggaggagcgcggccccttccgtggggccgaggaggaggatggcatataccggcccagcccggcggggaccccgctggagctggtgcgacggcctgagcgctcacgctcggtgcaggacctcagggctgtcggagagcctggcctcgtccgccgcctctcgctgtcactgtcccagcggctgcggcggacccctcccgcgcagcgccacccggcctgggaggcccgcggcggggacggagagagctcggagggcgggagctcggcgcggggctccccggtgctggcgatgcgcaggcggctgagcttcaccctggagcggctgtccagccgattgcagcgcagtggcagcagcgaggactcggggggcgcgtcgggccgcagcacgccgctgttcggacggcttcgcagggccacgtccgagggcgagagtctgcggcgccttggccttccgcacaaccagttggccgcccaggccggcgccaccacgccttccgccgagtccctgggctccgaggccagcgccacgtcgggctcctcagccccaggggaaagccgaagccggctccgctggggcttctctcggccgcggaaggacaaggggttatcgccaccaaacctctctgccagcgtccaggaggagttgggtcaccagtacgtgcgcagtgagtcagacttccccccagtcttccacatcaaactcaaggaccaggtgctgctggagggggaggcagccaccctgctctgcctgccagcggcctgccctgcaccgcacatctcctggatgaaagacaagaagtccttgaggtcagagccctcagtgatcatcgtgtcctgcaaagatgggcggcagctgctcagcatcccccgggcgggcaagcggcacgccggtctctatgagtgctcggccaccaacgtactgggcagcatcaccagctcctgtaccgtggctgtggcccgagtcccaggaaagctagctcctccagaggtaccccagacctaccaggacacggcgctggtgctgtggaagccgggagacagccgggcaccttgcacgtatacgctggagcggcgagtggatggggagtctgtgtggcaccctgtgagctcaggcatccccgactgttactacaacgtgacccacctgccagttggcgtgactgtgaggttccgtgtggcctgtgccaaccgtgctgggcaggggcccttcagcaactcttctgagaaggtctttgtcaggggtactcaagattcttcagctgtgccatctgctgcccaccaagaggcccctgtcacctcaaggccagccagggcccggcctcctgactctcctacctcactggccccacccctagctcctgctgcccccacacccccgtcagtcactgtcagcccctcatctccccccacacctcctagccaggccttgtcctcgctcaaggctgtgggtccaccaccccaaacccctccacgaagacacaggggcctgcaggctgcccggccagcggagcccaccctacccagtacccacgtcaccccaagtgagcccaagcctttcgtccttgacactgggaccccgatcccagcctccactcctcaaggggttaaaccagtgtcttcctctactcctgtgtatgtggtgacttcctttgtgtctgcaccaccagcccctgagcccccagcccctgagccccctcctgagcctaccaaggtgactgtgcagagcctcagcccggccaaggaggtggtcagctcccctgggagcagtccccgaagctctcccaggcctgagggtaccactcttcgacagggtccccctcagaaaccctacaccttcctggaggagaaagccaggggccgctttggtgttgtgcgagcgtgccgggagaatgccacggggcgaacgttcgtggccaagatcgtgccctatgctgccgagggcaagcggcgggtcctgcaggagtacgaggtgctgcggaccctgcaccacgagcggatcatgtccctgcacgaggcctacatcacccctcggtacctcgtgctcattgctgagagctgtggcaaccgggaactcctctgtgggctcagtgacaggttccggtattctgaggatgacgtggccacttacatggtgcagctgctacaaggcctggactacctccacggccaccacgtgctccacctagacatcaagccagacaacctgctgctggcccctgacaatgccctcaagattgtggactttggcagtgcccagccctacaacccccaggcccttaggccccttggccaccgcacgggcacgctggagttcatggctccggagatggtgaagggagaacccatcggctctgccacggacatctggggagcgggtgtgctcacttacattatgctcagtggacgctccccgttctatgagccagacccccaggaaacggaggctcggattgtggggggccgctttgatgccttccagctgtaccccaatacatcccagagcgccaccctcttcttgcgaaaggttctctctgtacatccctggagccggccctccctgcaggactgcctggcccacccatggttgcaggacgcctacctgatgaagctgcgccgccagacgctcaccttcaccaccaaccggctcaaggagttcctgggcgagcagcggcggcgccgggctgaggctgccacccgccacaaggtgctgctgcgctcctaccctggcggcccctagaggcacggaccacagccaggcctcgggcttcaactggggttcccaccaatgccacgggacattccagggcccacgctgagccaggcgggcctggggcttcggttaccaccagcagcaacatctggctgggctcttacctcatagaccttcaaggacagagaccccagggcctggacctgatgccaccccaggccaaagccagagtgggagacccattggtcaggctcagcagggtgggaacaggcagagggacaagaggggaatggagaagtggagaggaaaaggaatcgagggacaggaagggggaggctctaggaaggttctgggttgggggtcagtgcatctcagggagaaccaaggaaggtgggcatggctggagaggaggaaaaggaaggagccccaggtgtcagggcagtaggctgggagtcagtgtggcaaagcgggggcaggacacagatacagtggcaggggcccagggctgggacatgagagaaggcagcgaggcggcagagggagaagagaggactcaggtggaggtggggtgggtcagctgtcagcatccctcagaggagaaatgtggagagctggaggccagcagtcactcacactcgctctgtcctcctgtccagtggatacagccctgggcgctctgctggcccaaggatgtccccactgcccctccatggcctctggccttcttcccattcatatttatttatttattgacttttatgaagtttccccttccatccgatccctactgcccatgttgtcctgaccatccctcccagccatccagctgtctgtctgtctgccacaaggaaataaaaatggcaagcagcataa

SEQ ID NO: 185410 - DNA, 1086 bp, Homo sapiens
  Payload ID: 16515
  Gene Symbol: SPEG
  Gene Name: SPEG complex locus
  Uniprot ID: Q15772
  ENST ID: ENST00000396686
  CDS Start-End: 154-495
tccctcgagcgtttgggggtgcaagctgtagggctgtggccaacaggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgtgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctga

SEQ ID NO: 185411 - DNA, 1457 bp, Homo sapiens
  Payload ID: 16515
  Gene Symbol: SPEG
  Gene Name: SPEG complex locus
  Uniprot ID: Q15772
  ENST ID: ENST00000396688
  CDS Start-End: 339-680
caacctcctccttcccctcctcaggcgccttcccctcccccagggccttctccgtgcagggcctcagctgggtcagccgagtgagtggggctgggcaggctggacaggctgggctcctgctccctggggagccacgctggggtgggcagtgggcaggcagcaggagggcctggtgccagggcagagccttcaggacaggcacaggctggggtctgtgtgcagagcctcggggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgtgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaa

SEQ ID NO: 185412 - DNA, 1274 bp, Homo sapiens
  Payload ID: 16515
  Gene Symbol: SPEG
  Gene Name: SPEG complex locus
  Uniprot ID: Q15772
  ENST ID: ENST00000396689
  CDS Start-End: 135-476
ccgaggtcgggatgtgacttgtctgcggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgtgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaaataaagtccagtttgtaccta

SEQ ID NO: 185413 - DNA, 3379 bp, Homo sapiens
  Payload ID: 16515
  Gene Symbol: SPEG
  Gene Name: SPEG complex locus
  ENST ID: ENST00000396698
  CDS Start-End: 7-2583
cccgccatgaagaagctgtgggtgaagaagcgtttccagaaaaccggccattcccgccgggcctttggccgactcacccatgactcagagacggctgaggatgacatcagcgatgtgcagggaacccagcgcctggagcttcgggatgacggggccttcagcacccccacggggggttctgacaccctggtgggcacctccctggacacacccccgacctccgtgacaggcacctcagaggagcaagtgagctggtggggcagcgggcagacggtcctggagcaggaagcgggcagtgggggtggcacccgccgcctcccgggcagcccaaggcaagcacaggcaaccggggccgggccacggcacctgggggtggagccgctggtgcgggcatctcgagctaatctggtgggcgcaagctgggggtcagaggatagcctttccgtggccagtgacctgtacggcagcgcattcagcctgtacagaggacgggcgctctctatccacgtcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcgcactcaggagcctgtgctgcccgaggacaccaccaccgaagagaagcgagggaagaagtccaagtcgtccgggccctccctggcgggcaccgcggaatcccgaccccagacgccactgagcgaggcctcaggccgcctgtcggcgttgggccgatcgcctaggctggtgcgcgccggctcccgcatcctggacaagctgcagttcttcgaggagcgacggcgcagcctggagcgcagcgactcgccgccggcgcccctgcggccctgggtgcccctgcgcaaggcccgctctctggagcagcccaagtcggagcgcggcgcaccgtggggcacccccggggcctcgcaggaagaactgcgggcgccaggcagcgtggccgagcggcgccgcctgttccagcagaaagcggcctcgctggacgagcgcacgcgtcagcgcagcccggcctcagacctcgagctgcgcttcgcccaggagctgggccgcatccgccgctccacgtcgcgggaggagctggtgcgctcgcacgagtccctgcgcgccacgctgcagcgtgccccatcccctcgagagcccggcgagcccccgctcttctctcggccctccacccccaagacatcgcgggccgtgagccccgccgccgcccagccgccctctccgagcagcgcggagaagccgggggacgagcctgggaggcccaggagccgcgggccggcgggcaggacagagccgggggaaggcccgcagcaggaggttaggcgtcgggaccaattcccgctgacccggagcagagccatccaggagtgcaggagccctgtgccgccccccgccgccgatcccccagaggccaggacgaaagcaccccccggtcggaagcgggagcccccggcgcaggccgtgcgcttcctgccctgggccacgccgggcctggagggcgctgctgtaccccagaccttggagaagaacagggcggggcctgaggcagagaagaggcttcgcagagggccggaggaggacggtccctgggggccctgggaccgccgaggggcccgcagccagggcaaaggtcgccgggcccggcccacctcccctgagctcgagtcttcggatgactcctacgtgtccgctggagaagagcccctagaggcccctgtgtttgagatccccctgcagaatgtggtggtggcaccaggggcagatgtgctgctcaagtgtatcatcactgccaaccccccgccccaagtgtcctggcacaaggatgggtcagcgctgcgcagcgagggccgcctcctcctccgggctgagggtgagcggcacaccctgctgctcagggaggccagggcagcagatgccgggagctatatggccaccgccaccaacgagctgggccaggccacctgtgccgcctcactgaccgtgagacccggtgggtctacatcccctttcagcagccccatcacctccgacgaggaatacctgagccccccagaggagttcccagagcctggggagacctggccgcgaacccccaccatgaagcccagtcccagccagaaccgccgttcttctgacactggctccaaggcaccccccaccttcaaggtctcacttatggaccagtcagtaagagaaggccaagatgtcatcatgagcatccgcgtgcagggggagcccaagcctgtggtctcctggctgagaaaccgccagcccgtgcgcccagaccagcggcgctttgcggaggaggctgagggtgggctgtgccggctgcggatcctggctgcagagcgtggcgatgctggtttctacacttgcaaagcggtcaatgagtatggtgctcggcagtgcgaggcccgcttggaggtccgaggcgagtgagctcagggggccacctgtgctccccccgctaccctccgagccgcgcccctgtctcaggcacctctcggacctcgctgtgtttcactgcctcctgcccacagacccaggcctgccggcccggacccgtcccagcctcccctccccaccccatgcagcccccagggggatagcccatgggcccctgtggaccctccctccccaagtggacacatggctgtgcaggccaggaggcccacagatggactgagtgctgggaaggggcggctgcgaggggtatcaaccccccgagtctctccctgaaggggagcaccgggcgagtgcatgtgctactgctgctacaggcctgtctatctgtttgtctgtctgtgtgtctgtgacagtcagggaaggatgcctcggagctgaggtggggtgagacagagtgggagagattacggcatggcatggaggggcccaaggagcaggggctgttgacaaaggccttaccaggaagggttaggacactgaccattctagaaatgggtttcgaatggcacaacactttctatttcacaaaagaccaaaagccagaggccccaggctctgtgctgatgaacagcctggctgagccctggccctggcaggtttagggcccatttggggccccctccttctctgtcagggctggggtgctctgtctgggaatgagggagttaaccaagtttggtgcaggagcaggggcagggggccactgtagtgagcgtggagaaatttggaaacacctatttcttaactcaaataaagtccagtttgtacc

SEQ ID NO: 185414 - DNA, 546 bp, Homo sapiens
  Payload ID: 16515
  Gene Symbol: SPEG
  Gene Name: SPEG complex locus
  ENST ID: ENST00000403148
  CDS Start-End: 36-197
ctcgcccggccgccggcccggccccctcccccgccatgaagaagctgtgggtgaagaagcgtttccagaaaaccggccattcccgccgggcctttggccgactcacccatggtgcgtggaccgtgggcgtccttgctctagcccatgcctactcctcctcttggtccctgtccctctgtgaggcatcgagttcctgaagacagcccatgagatgtggaaccctcccactcacccccacacttatctaccacccacccgaccaggccccctgtgccctacagctgagagaggacccagcagaagggagggcggctcactagcacacccctgcatggactgggtgccctgttctccatgtgaggcctaatgggaaggagttcattgccatgctttggcaaccacgaagttttccgctcctgcagaaagcaaagttacgactcagagacggctgaggatgacatcagcgatgtgcagggaacccagcgcctggagcttcgggatgacggggccttcagcacccccacggggggttctgacaccctggtg

SEQ ID NO: 185415 - DNA, 420 bp, Homo sapiens
  Payload ID: 16515
  Gene Symbol: SPEG
  Gene Name: SPEG complex locus
  ENST ID: ENST00000409595
  CDS Start-End: 1-130
atctcgagctaatctggtgggcgcaagctgggggtcagaggatagcctttccgtggccagtgacctgtacggcagcgcattcagcctgtacagaggacgggcgctctctatccacgtagtcttcggatgactcctacgtgtccgctggagaagagcccctagaggcccctgtgtttgagatccccctgcagaatgtggtggtggcaccaggggcagatgtgctgctcaagtgtatcatcactgccaaccccccgccccaagtgtcctggcacaaggatgggtcagcgctgcgcagcgagggccgcctcctcctccgggctgagggtgagcggcacaccctgctgctcagggaggccagggcagcagatgccgggagctatatggccaccgccaccaacgagctgggccaggccacctgtg

SEQ ID NO: 185416 - DNA, 1085 bp, Homo sapiens
  Payload ID: 16515
  Gene Symbol: SPEG
  Gene Name: SPEG complex locus
  ENST ID: ENST00000412982
  CDS Start-End: 1-1030
tatgctcagtggacgctccccgttctatgagccagacccccaggaaacggaggctcggattgtggggggccgctttgatgccttccagctgtaccccaatacatcccagagcgccaccctcttcttgcgaaaggttctctctgtacatccctggagccggccctccctgcaggactgcctggcccacccatggttgcaggacgcctacctgatgaagctgcgccgccagacgctcaccttcaccaccaaccggctcaaggagttcctgggcgagcagcggcggcgccgggctgaggctgccacccgccacaagatgtctaaagcagctcctgccaaaaagccagtggctgtggccccagctcctggatgtaccctggacatcaatgacccacaggtccagagtgcggccattcgtatccaggcctcttaccggggccacaggtcccggaaggagctgcgcgagaaggggccgccgcgggtgctggagccgctgaaggacgtggtgctgatcgaaggcagcgcggccaagctcacttgccgcatttcggctttcccggacccattcatccgctggagtaaggacggcaaggagctacgtgacggtcccaagtaccgctacgtcttcgaggaccctgacgtggtggcactggtggtgcgcgacggcgagctggcagacctgggccagtacagcatcaacgtcaccaaccccttcggccagtgctccgactcggcgcgcatcctcgtggaagtcccgacgaagattcaaaagggacccgacaacactaaggcgcgcaaaggcaccaccgtgacgctgactgcggagatcctgggagagcctgcgcccgacgtaggctggaccaaggacggggaggacatcgaggaggatgacagggtgttcttcgagatcggcagcaccaccacgacgctgaccattcgccgggccacgcctcaggacagcggcaagtacgaggtgtacgtggagaacagcctgggcatggaccagagcttcgctcgcgtcgacgtggcctgaacggcacccccggaccttccgccctggcgccgagcccgggggtggtgggacccac

SEQ ID NO: 185417 - DNA, 605 bp, Homo sapiens
  Payload ID: 16515
  Gene Symbol: SPEG
  Gene Name: SPEG complex locus
  ENST ID: ENST00000435853
  CDS Start-End: 43-605
acagtgtgtgtgcgcgcatgtttgtggaatgagcaagtcgagatgctgctgaccttccagagaggccccgcgggaggagaaaaccggccattcccgccgggcctttggccgactcacccatgcgaagttttccgctcctgcagaaagcaaagttacgactcagagacggctgaggatgacatcagcgatgtgcagggaacccagcgcctggagcttcgggatgacggggccttcagcacccccacggggggttctgacaccctggtgggcacctccctggacacacccccgacctccgtgacaggcacctcagaggagcaagtgagctggtggggcagcgggcagacggtcctggagcaggaagcgggcagtgggggtggcacccgccgcctcccgggcagcccaagcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcg

SEQ ID NO: 185418 - DNA, 579 bp, Homo sapiens
  Payload ID: 16515
  Gene Symbol: SPEG
  Gene Name: SPEG complex locus
  ENST ID: ENST00000420132
  CDS Start-End: 3-164
ccatgaagaagctgtgggtgaagaagcgtttccagaaaaccggccattcccgccgggcctttggccgactcacccatggtgcgtggaccgtgggcgtccttgctctagcccatgcctactcctcctcttggtccctgtccctctgtgaggcatcgagttcctgaagacagcccatgagatgtggaaccctcccactcacccccacacttatctaccacccacccgaccaggccccctgtgccctacagctgagagaggacccagcagaagggagggcggctcactagcacacccctgcatggactgggtgccctgttctccatgtgaggcctaatgggaaggagttcattgccatgctttggcaaccattttccgctcctgcagaaagcaaagttacgactcagagacggctgaggatgacatcagcgatgtgcagggaacccagcgcctggagcttcgggatgacggggccttcagcacccccacggggggttctgacaccctggtgggcacctccctggacacacccccgacctccgtgacaggcacctcagaggagcaagtgagctggtggggcag

SEQ ID NO: 185419 - DNA, 583 bp, Homo sapiens
  Payload ID: 16515
  Gene Symbol: SPEG
  Gene Name: SPEG complex locus
  ENST ID: ENST00000452101
  CDS Start-End: 5-259
cgccatgaagaagctgtgggtgaagaagcgtttccagaaaaccggccattcccgccgggcctttggccgactcacccatgcgaagttttccgctcctgcagaaagcaaagttacgactcagagacggctgaggatgacatcagcgatgtgcagggaacccagcgcctggagcttcgggatgacggggccttcagcacccccacggggggttctgacaccctggtgggcacctccctggacacacccccgacctccgtgacaggcacctcagaggagcaagtgagctggtggggcagcgggcagacggtcctggagcaggaagcgggcagtgggggtggcacccgccgcctcccgggcagcccaagcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcgcactcaggagcctgtgctgc

SEQ ID NO: 185420 - DNA, 926 bp, Homo sapiens
  Payload ID: 16515
  Gene Symbol: SPEG
  Gene Name: SPEG complex locus
  ENST ID: ENST00000431523
  CDS Start-End: 29-926
ggccgccggcccggccccctcccccgccatgaagaagctgtgggtgaagaagcgtttccagaaaaccggccattcccgccgggcctttggccgactcacccatgttttccgctcctgcagaaagcaaagttacgactcagagacggctgaggatgacatcagcgatgtgcagggaacccagcgcctggagcttcgggatgacggggccttcagcacccccacggggggttctgacaccctggtgggcacctccctggacacacccccgacctccgtgacaggcacctcagaggagcaagtgagctggtggggcagcgggcagacggtcctggagcaggaagcgggcagtgggggtggcacccgccgcctcccgggcagcccaagcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcgcactcaggagcctgtgctgcccgaggacaccaccaccgaagagaagcgagggaagaagtccaagtcgtccgggccctccctggcgggcaccgcggaatcccgaccccagacgccactgagcgaggcctcaggccgcctgtcggcgttgggccgatcgcctaggctggtgcgcgccggctcccgcatcctggacaagctgcagttcttcgaggagcgacggcgcagcctggagcgcagcgactcgccgccggcgcccctgcggccctgggtgcccctgcgcaaggcccgctctctggagcagcccaagtcggagcgcggcgcaccgtggggcacccccggggcct

SEQ ID NO: 185421 - DNA, 551 bp, Homo sapiens
  Payload ID: 16515
  Gene Symbol: SPEG
  Gene Name: SPEG complex locus
  ENST ID: ENST00000451076
  CDS Start-End: 1-551
agagacggctgaggatgacatcagcgatgtgcagggaacccagcgcctggagcttcgggatgacggggccttcagcacccccacgggcacctcagaggagcaagtgagctggtggggcagcgggcagacggtcctggagcaggaagcgggcagtgggggtggcacccgccgcctcccgggcagcccaaggcaagcacaggcaaccggggccgggccacggcacctgggggtggagccgctggtgcgggcatctcgagctaatctggtgggcgcaagctgggggtcagaggatagcctttccgtggccagtgacctgtacggcagcgcattcagcctgtacagaggacgggcgctctctatccacgtcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgt

SEQ ID NO: 185422 - DNA, 815 bp, Homo sapiens
  Payload ID: 16515
  Gene Symbol: SPEG
  Gene Name: SPEG complex locus
  ENST ID: ENST00000617028
  CDS Start-End: 1-717
atgtctaaagcagctcctgccaaaaagccagtggctgtggccccagctcctggatgtaccctggacatcaatgacccacaggtccagagtgcggccattcgtatccaggcctcttaccggggccacaggtcccggaaggagctgcgcgagaaggggccgccgcgggtgctggagccgctgaaggacgtggtgctgatcgaaggcagcgcggccaagctcacttgccgcatttcggctttcccggacccattcatccgctggagtaaggacggcaaggagctacgtgacggtcccaagtaccgctacgtcttcgaggaccctgacgtggtggcactggtggtgcgcgacggcgagctggcagacctgggccagtacagcatcaacgtcaccaaccccttcggccagtgctccgactcggcgcgcatcctcgtggaagtcccgacgaagattcaaaagggacccgacaacactaaggcgcgcaaaggcaccaccgtgacgctgactgcggagatcctgggagagcctgcgcccgacgtaggctggaccaaggacggggaggacatcgaggaggatgacagggtgttcttcgagatcggcagcaccaccacgacgctgaccattcgccgggccacgcctcaggacagcggcaagtacgaggtgtacgtggagaacagcctgggcatggaccagagcttcgctcgcgtcgacgtggcctgaacggcacccccggaccttccgccctggcgccgagcccgggggtggtgggacccacagccctccaccagcttgcttaataaagctgctctctgaccctc

SEQ ID NO: 185423 - DNA, 12232 bp, Homo sapiens
  Payload ID: 16516
  Gene Symbol: SPEN
  Gene Name: spen family transcriptional repressor
  Uniprot ID: Q96T58
  ENST ID: ENST00000375759
  CDS Start-End: 205-11199
tgagctgcgaggcccgagagtcagaacctgggggagagggatggtctctgcacgggggggagccggaggagccgccgccgctgccgacgccaccgccgcagccgccgccgccgccgccccggcacccgcctcccggcgctgacggtctcgtacgaagccggcgagggggagccagcagcggcggtcgccggcacgccgcccagcatggtccgggaaaccaggcatctctgggtgggcaacttacccgagaacgtgcgggaagagaagatcatcgagcatttcaaacgatatggccgcgtggaaagtgtcaaaattcttcccaagaggggatctgaaggaggagtggctgcctttgtggattttgtggacatcaaaagtgcacagaaagctcacaactcggtcaacaaaatgggtgacagagacctacgcacggattataatgaaccaggcaccatcccgagtgctgctcggggattggatgatacagtttccatagcatctcgtagtagagaggtttctgggttcagaggaggtggtggagggcctgcttatggtcccccaccgtcacttcatgcacgagaaggacgttatgagcggagacttgatggggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacagcagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacagatacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccagaaacagaaagtgaaaatgaatttcgccccttggatgaaaggatagatgaatttcaccccaaagcaacaagaactctctttattggcaaccttgaaaaaaccactacttaccatgaccttcgcaacatcttccagcgctttggagaaattgtggatattgacattaagaaagtaaatggagttcctcagtatgcgtttctgcaatactgtgatattgctagcgtttgtaaagctattaagaagatggatggggaatatcttggaaataatcgcctcaagctgggttttggaaagagcatgcctacaaactgcgtgtggctagatgggctttcttcgaatgtgtcagatcagtatttaacacgacatttctgccgatatgggcctgtggtaaaggtggtgtttgaccgcttaaaaggcatggccctggttctctacaatgaaattgaatatgcacaagcagctgtaaaagagaccaaagggaggaaaatcggtgggaataaaattaaggtggattttgcaaatcgggaaagtcagctggctttttatcactgcatggagaaatctggtcaagacatcagagacttttatgaaatgttagccgaaagaagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaagttgaaagccaagcttgataatgacactgtcaaatcttctgccctggaccagaaacttcaggtctctcagacggagcctgcaaaatctgacttgtctaaactggaatcagttagaatgaaagtaccaaaggaaaaggggctttcaagccatgttgaagtggtggagaaggaaggcaggcttaaagccaggaagcacctcaagcctgagcagcctgcagatggggtaagtgctgtggatctggagaagctggaagccaggaaaaggcgctttgcagattccaatttaaaagcagaaaagcaaaaaccagaggtcaagaaaagcagtccagagatggaggatgctcgcgtgctttcaaaaaagcagcctgacgtgtcctctagagaggtcattctgctgagggaaggagaggctgaaagaaagcctgtgaggaaagaaattcttaaaagagaatctaaaaaaatcaaactggacagacttaatactgttgccagccccaaagactgtcaggagcttgccagtatttctgttgggtctggctcaaggcccagctcagacctacaagcaagactgggagaactagcaggtgaatctgtggaaaatcaagaagtccaatcaaaaaagcccattccctcaaaaccacagctcaaacagctgcaggtattagatgatcaaggaccagagagagaagacgttaggaaaaactattgcagtcttcgtgatgaaacacctgaacgtaaatcaggccaagagaaatcacattcagtaaatactgaagaaaaaattggcattgacatcgatcacacgcagagttaccgaaaacaaatggaacagagtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatccttatgattctagcaggagagaacagatggcagatatggccaaaataaaactatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaagttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaatccctctcttcatctcgtgaagaaaattggtcttttcttgattgggactcccgatttgcaaattttcgaaacaacaaagataaagaaaaggttgactctgctccaagacctattccatcctggtacatgaaaaagaagaaaattaggactgattcagaagggaaaatggatgataagaaagaggaccataaagaagaagagcaagagaggcaggaattgtttgcttctcgttttttacacagctcaatctttgaacaagattccaagcgattgcagcatctagagagaaaagaggaagattctgacttcatttctggtaggatctatgggaagcagacatctgagggagcaaacagcacaactgattccattcaagaaccagtagttctgttccatagcagatttatggagctcacacggatgcaacagaaagaaaaagaaaaagaccagaaacccaaagaggttgagaaacaggaagatacagagaatcatcccaagaccccagaatctgctcctgagaataaagattcagaactgaaaactccaccttccgttgggcctccaagtgtcacagtcgtaactctagaatcagccccatcagcactagagaagaccactggtgacaaaacggtagaggcgcctttggtaacagaagagaagactgtggagccagctaccgtctcagaagaagcaaagcctgcatctgaacctgctcctgcccctgtggaacagctggaacaagtagacctgcccccaggagcagaccccgataaagaagctgccatgatgcctgcgggtgttgaggaaggttcatcaggtgaccagccgccttatctggatgccaagcctccaactcccggggcctcgttttcccaggcagagagcaacgtagatccagagcctgacagtacccagccactttcaaaaccagctcagaagtctgaggaagccaatgagccaaaggccgaaaagccagacgccactgcagatgctgagcctgatgcaaaccagaaagccgaagctgctcctgagtctcagcccccagcttctgaagatttagaggttgatcctccagttgctgcaaaggataaaaagccaaacaaaagcaagcgttcaaagacccctgttcaggcagctgcagtgagtatcgtggagaagcccgtcacaaggaagagtgagaggatagaccgggaaaaactcaagcggtccaattctcctcggggagaagcacagaagcttttggaattgaagatggaggcagagaagattacaaggactgcttctaaaaactctgctgcagaccttgaacatcccgaaccaagtttgcctctcagccgaacaaggcgccggaatgtaaggagcgtctatgcaaccatgggtgaccatgaaaaccgctctcctgtcaaagagcccgttgagcaaccaagagtgaccagaaagagattggagcgagagcttcaggaggctgcagcggttcccaccacccctcggaggggaaggcctccaaagacacgccggcgagccgatgaagaggaggagaacgaggccaaggaacctgcagaaacactcaagccacctgagggatggcggtcgccaaggtcccagaaaactgcagctggtggtggaccccaagggaaaaagggaaaaaatgaaccgaaggtggatgctacacgtcctgaggccaccactgaggtgggcccccaaataggcgtgaaagagagctccatggaacccaaggctgctgaggaggaggcagggagtgaacagaaacgtgacagaaaagatgctggcacagacaaaaacccccctgaaaccgcccctgttgaagttgtagagaaaaaaccggcccctgaaaaaaactccaaatcaaagagaggaagatctcgaaactccaggttagcagtggacaaatctgcaagtctgaaaaatgtggatgctgctgtcagtcccaggggggctgcagcacaggcaggggagagggaatctggggtggtggcagtctcccctgagaaaagtgagagtccccaaaaggaggatggtttatcatcccagttgaaaagtgatccagttgatccagacaaggaaccagagaaagaagacgtgtctgcctctgggccgtccccagaagccacccagttagccaagcagatggagctggagcaggccgtggaacacatcgcaaagctcgctgaggcctctgcctctgctgcctataaggcagatgcaccagagggccttgccccagaggacagggacaagcctgcacaccaagcaagtgaaacagagctggctgcggccatcggctccatcatcaatgacatttctggggagccagaaaacttcccagcacctccaccttatcctggagaatcccagacagatctgcaaccccccgcaggtgcacaggcgctgcagccttctgaggaaggaatggagacagatgaggctgtatctggcatcctggaaactgaggctgctacagaatcttctaggcctccagtcaatgctcctgacccctcagccggcccaacagataccaaggaagccagaggaaatagcagtgaaacctcacactcagtgccagaagccaaagggtctaaagaagtggaagtcactcttgttcggaaagacaaagggcgccagaaaacaacccgatcacgccgcaagcgaaacacaaacaagaaagtggtggctcctgtagagagccatgtccctgaatccaaccaagctcaaggtgagagtcctgctgcaaatgaggggacaacagtacagcaccccgaagccccacaggaagaaaagcagagtgagaaaccccattccactcctcctcagtcatgtacttctgacctaagcaagattccctccacagagaattcgtcccaagaaatcagtgttgaggaaaggactccaaccaaagcatctgtgcccccagaccttcccccacctccccagccagcaccggtggatgaggagcctcaagccaggttcagggtgcattccatcattgaaagtgacccggtgaccccacccagcgatccaagcatccccatacccacactgccttctgtaactgcagcaaagctctcacctcctgtcgcctctggggggatcccacaccagagcccccctactaaggtgacagagtggatcacaaggcaggaggagccacgggctcagtctactccatctccagctcttcccccagacacaaaggcctctgatgttgacaccagctccagcaccctgaggaagattctcatggaccccaagtatgtgtctgccacaagtgtcacttccacaagtgtcaccacagccattgcagagcctgtcagtgctgccccttgcctacatgaggccccgcccccgccagttgactctaaaaagcctttagaagaaaaaacagcacctccagtgacaaacaactctgagatacaagcctcggaggtgctggtagctgctgacaaggaaaaggtggctccagtcattgctcccaaaattacctctgttattagccggatgcctgtcagcattgacctggaaaattcacagaagataaccttggcaaaaccagctcctcaaaccctcactggtctggtgagcgcactcactggcctggtgaacgtctccctggtcccggtgaatgccctgaaaggccccgtgaagggctcagtgaccacactgaaaagtttggtgagcacccctgctgggcccgtgaacgtcctgaaagggcctgtgaatgttcttacggggccagtgaatgttctcaccactccagtgaacgccacggtgggcacagtgaatgccgccccaggcacagtcaatgccgctgcgagtgcagtgaatgccacagcaagtgcagtgaccgtcacagcgggtgcggttactgctgcatctggtggtgtaacggccacaacaggcacggtgacaatggcaggggcagtgattgcgccgtcaacaaagtgcaaacagagagcgagtgctaatgaaaacagtcggttccacccagggtccatgcctgtgatcgacgatcgtccggcagacgcgggctcaggggcggggctgcgtgtgaacacttctgaaggggttgtgctcctgagttactcagggcagaagaccgaaggcccacagcggatcagcgccaagatcagccagatccccccggccagtgcaatggacattgaatttcagcagtcagtgtccaagtcccaggtcaaacctgattctgtcacagcatcgcagcctccatccaaaggccctcaagctcctgcaggctatgcgaacgtggccacccattccacgttggtactgaccgcccagacatataatgcctctcctgtgatttcgtctgtgaaggccgataggccatccttggagaagcccgagcccattcacctctcggtgtccacgcctgtcacccagggaggcacagtgaaggttctcacccaggggatcaacacaccccctgtgctggttcacaaccagctggtcctcaccccaagcattgtcaccacaaacaagaagcttgctgaccccgtcacccttaaaatcgagaccaaggtccttcagccggccaacctggggtccacgctcacgccccaccaccctcctgctctgcccagcaaactgcctacagaagtcaaccatgtcccctcggggcccagcatcccagcagatcgaactgtctcccatttggcagctgcaaagctagatgctcattctcctcgaccaagtggacccgggccatcctcattcccaagggcaagccaccccagcagtactgcatctacggcgctctccaccaacgccacagtcatgctggctgcaggcatcccagtgccccagttcatctccagcatccacccagagcagtctgtcatcatgccaccccacagcatcacccagactgtgtccctgagccacctctcccagggcgaggtgagaatgaacactcccacgctgcccagtatcacctacagcatccggccagaagcgcttcactctcctcgggctccgctgcagccccagcaaatagaggtcagggccccacagcgtgccagcaccccgcagccagccccagctggtgtgcctgcactggcctcccagcaccctcccgaggaggaagtgcattatcaccttcctgtcgctcgagccacagcccctgtgcagtcagaggtactagtcatgcagtctgagtaccgactgcacccctatactgtgccacgggatgtgaggatcatggtgcatccacatgtgacggcagtcagcgagcagcccagggccgcggatggggtggtgaaggtgccaccagccagcaaggcccctcagcagccagggaaggaagctgccaagacaccagatgccaaagctgcccccacccccacccctgcccccgtccctgtccctgtcccccttcctgcccctgctcctgcccctcatggtgaggcccgtatcctcacagttacccccagtaaccaactccaggggctgcctctgacccctcctgtggtggtgacccatggggtgcagattgtgcactccagcggggagctgtttcaagagtaccggtacggcgacatccgcacctaccaccccccggcccagctcacacacactcagtttcccgccgcttcctctgttggcctgccttcccggaccaagacagctgctcagggccctcctcctgaaggtgagcccctgcagcctcctcagcctgtgcagtccacacagcctgcccagcctgcaccaccctgcccgccctcccagctcggtcagcccggccagccaccaagcagcaagatgcctcaagtgtcccaggaggcaaaggggacccagacgggagtagagcagcctcgcctcccagctggacctgcaaacaggccacctgagcctcacacccaggttcagagggcacaagcagaaacaggcccgacttccttcccctcccctgtgtctgtctccatgaagcctgaccttccagtctctcttcccactcagactgccccaaaacagccgttgtttgtcccaacaacctctggccccagcaccccaccaggactggttctgccacacactgaattccagccagcccccaaacaagattcctctccacacctgacttcccagagacccgtggatatggttcaacttctgaagaagtaccccatcgtgtggcagggcctgctggccctcaagaatgacacagctgctgtgcagctccacttcgtctctggcaacaacgtcctggcccatcggtccctgcccctttctgaaggagggcccccactaaggatcgcccagaggatgcggctggaggcaacgcagctggaaggggttgcccgaaggatgacggtggagacagattactgtctgctgctggctctgccctgtggccgtgaccaagaggatgttgtgagccagaccgagtccctcaaggctgccttcatcacttacctgcaggccaagcaggcggcagggatcatcaacgttcccaaccctggctccaatcagcctgcctacgtgctgcagatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagccaagcagaggaagaagctgccgaaggggacagactccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacacaccaa

SEQ ID NO: 185424 - DNA, 1733 bp, Homo sapiens
  Payload ID: 16516
  Gene Symbol: SPEN
  Gene Name: spen family transcriptional repressor
  ENST ID: ENST00000438066
  CDS Start-End: 614-1733
ctatatggaatatttctggaatattagagcctacagattcttttagaagttgatatctgcctctccattttcactacataaagtgtacaaacaaattggattgtaacaaaaaatctggcagaccataatgattcaaccacttggattctacaaacaatactttaacatggaaatgtgtacttggatgaagaagagagaaggcaatgcctgatttttccattttggatctacacaatttctgtattgttggaattacactctttgatggaatggggaaaaattaaaatgatggatgtttcctaaatcctggaatatagccattcttttctaattgctgggatatatgggatgtcttgctgtcaagattccactagcccagggaaagaggattactatatcatttcttaagcaagttgctgtccaatcaaaggtactttagctttgaacacatggtgatgatcagttgtggatacagcaatcaaaattgactgggctggatggctacaaaagtgaactattggcgagcaactgtgccttcctcattcgttggaattgtagaggatatttcctcttctgccagctacctgattcatacttagggctggaaatatttatgaatgtggataaatttctaattgtctgctatctcaagaaagaagtctgggggtttgagagttacagtttgtctgggactacttgcttccagtggaattattttgtctggtcactaagattttttttttcttgtggttcatctaaatatcatttgacacccttgcccattaagaaggtggattacccccataagaggggccaaaattggggaagttatgttcacaattctctccctagatttaattgggattataggtcgtgtttccacacttggaaaagggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacagcagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacagatacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccag

SEQ ID NO: 185425 - DNA, 891 bp, Homo sapiens
  Payload ID: 16516
  Gene Symbol: SPEN
  Gene Name: spen family transcriptional repressor
  ENST ID: ENST00000442985
  CDS Start-End: 1-891
gccaagcatctagacccacaaggtcccctagcggcagcggctctagaagtagatcctccagtagtgattcaatcagcagcagcagtagtaccagcagtgacagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacagatacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccagaaacagaaagtgaaaatgaatttcgccccttggatgaaaggatagatgaatttcaccccaaagcaacaagaactctctttattggcaaccttgaaaaaaccactacttaccatgaccttcgcaacatcttccagcgctttggagaaattgtggatattgacattaagaaagtaaatggagttcctcagtatgcgtttctgcaatactgtgatattgctagcgtttgtaaagctattaagaagatggatggggaatatcttggaaataatcgcctcaagctgggttttggaaagagcatgcctacaaactgcgtgtggctagatgggctttcttcgaatgtgtcagatcagtatttaacacgacatttctgccgatatgggcctgtggtaaaggtggtgtttgaccgcttaaaaggcatggccctggttc

SEQ ID NO: 185426 - DNA, 1499 bp, Homo sapiens
  Payload ID: 16517
  Gene Symbol: SPACA1
  Gene Name: sperm acrosome associated 1
  Uniprot ID: Q9HBV2
  ENST ID: ENST00000237201
  CDS Start-End: 118-1002
gtcacgggattcggagccgggcggctacgggcggggtgtcgcagctctcttcgacgtacctgtcctcaggagccgcggcggcgactgcgcctcggacggccgtcggggccgagaaccatgagccccaggggcacgggctgctccgccgggctgctgatgactgtcggctggctgcttctggcgggcctccagtccgcgcgcgggaccaacgtcaccgctgccgtccaggatgccggcctggcccacgaaggcgagggcgaggaggagaccgaaaacaacgacagcgagaccgcggagaactacgctccgcctgaaaccgaggatgtttcaaataggaatgtcgtcaaagaagtagaattcggaatgtgcaccgttacatgtggtattggtgttagagaagttatattaacaaatggatgccctggtggtgaatccaagtgtgttgtacgggtagaagaatgccgtggaccaacagattgtggctggggtaaaccaatttcagaaagtcttgaaagtgttagattggcatgtattcacacatctcccttaaatcgtttcaaatatatgtggaaacttctaagacaagaccaacaatccattatacttgtaaatgattcagcaatcctagaagtacgcaaggaaagtcaccccttggctttcgagtgtgacacactggataataatgaaatagtagcaactattaaattcacagtctatacgagcagtgaattgcagatgagaagatcaagcctaccagccactgatgcagccctaatttttgtgctgaccataggagtcattatctgtgtatttataattttcttattgatcttcataatcataaattgggcagcagtcaaggctttctggggggcaaaagcctctacacctgaggtacaatccgagcagagttctgtgagatacaaagattcaacttctcttgaccaattaccaacagaaatgcctggtgaagatgatgctttaagtgaatggaatgaatgatgtttgaatgatatataacaaaccaaaggatattacagaatattagattcattattacaaaaataaaatacacattgaaatactttaataatgttgcgatggattgccacagtgtgaaggaaatgcagtgtggggataggactattttatcagtgcatttttccagtacagttatcaaatattacttttaatttgttctcaacacttatttcaggtaatagcttggggatatttatctaaaggtacccccaacaaatcttctaagtgcatttttgatcactttgataacttcttaggtgatttgcctgttttgtcttaaataagaacaatgtaatatagaaatgctttacatattagactttctctcccctggaagcactgggttgaacttgctaaagtaaatcatactttagaatctcttcagggaatgtgacatacaaagtttgtaagacatgaagtaataacgataatgataacaataaatgcttacttagtga

SEQ ID NO: 185427 - DNA, 817 bp, Homo sapiens
  Payload ID: 16518
  Gene Symbol: SPACA3
  Gene Name: sperm acrosome associated 3
  Uniprot ID: Q8IXA5
  ENST ID: ENST00000269053
  CDS Start-End: 71-718
ggcaaggttgtgggggacatcttgagctgaagcagggttttgagccactgctgctgctgccattgtcaccatggtctcagctctgcggggagcacccctgatcagggtgcactcaagccctgtttcttctccttctgtgagtggaccacggaggctggtgagctgcctgtcatcccaaagctcagctctgagccagagtggtggtggctccacctctgccgccggcatagaagccaggagcagggctctcagaaggcggtggtgcccagctgggatcatgttgttggccctggtctgtctgctcagctgcctgctaccctccagtgaggccaagctctacggtcgttgtgaactggccagagtgctacatgacttcgggctggacggataccggggatacagcctggctgactgggtctgccttgcttatttcacaagcggtttcaacgcagctgctttggactacgaggctgatgggagcaccaacaacgggatcttccagatcaacagccggaggtggtgcagcaacctcaccccgaacgtccccaacgtgtgccggatgtactgctcagatttgttgaatcctaatctcaaggataccgttatctgtgccatgaagataacccaagagcctcagggtctgggttactgggaggcctggaggcatcactgccagggaaaagacctcactgaatgggtggatggctgtgacttctaggatggacggaaccatgcacagcaggctgggaaatgtggtttggttcctgacctaggcttgggaagacaagccagcgaataaaggatggttgaacgtgaa

SEQ ID NO: 185428 - DNA, 508 bp, Homo sapiens
  Payload ID: 16518
  Gene Symbol: SPACA3
  Gene Name: sperm acrosome associated 3
  ENST ID: ENST00000394638
  CDS Start-End: 71-409
ggcaaggttgtgggggacatcttgagctgaagcagggttttgagccactgctgctgctgccattgtcaccatggtctcagctctgcggggagcacccctgatcagggtctgccttgcttatttcacaagcggtttcaacgcagctgctttggactacgaggctgatgggagcaccaacaacgggatcttccagatcaacagccggaggtggtgcagcaacctcaccccgaacgtccccaacgtgtgccggatgtactgctcagatttgttgaatcctaatctcaaggataccgttatctgtgccatgaagataacccaagagcctcagggtctgggttactgggaggcctggaggcatcactgccagggaaaagacctcactgaatgggtggatggctgtgacttctaggatggacggaaccatgcacagcaggctgggaaatgtggtttggttcctgacctaggcttgggaagacaagccagcgaataaaggatggttgaacgtgaa

SEQ ID NO: 185429 - DNA, 949 bp, Homo sapiens
  Payload ID: 16518
  Gene Symbol: SPACA3
  Gene Name: sperm acrosome associated 3
  Uniprot ID: Q8IXA5
  ENST ID: ENST00000580599
  CDS Start-End: 410-850
ttgtgactaaaagctggcctagcaggccagggagtgcagctgcaggcgtgggggtggcaggagccgcagagccagagcagacagccgagaaaaaggtggacagtgtgaaagaaccagtggtctcgctctgttgcccaggctagagtgtactggcgtgatcatagctcactgcagcctcagactcctggacttgagaaatcctcctgccttagcctcctgcatatctgggactccaggggtgcactcaagccctgtttcttctccttctgtgagtggaccacggaggctggtgagctgcctgtcatcccaaagctcagctctgagccagagtggtggtggctccacctctgccgccggcatagaagccaggagcagggctctcagaaggcggtggtgcccagctgggatcatgttgttggccctggtctgtctgctcagctgcctgctaccctccagtgaggccaagctctacggtcgttgtgaactggccagagtgctacatgacttcgggctggacggataccggggatacagcctggctgactgggtctgccttgcttatttcacaagcggtttcaacgcagctgctttggactacgaggctgatgggagcaccaacaacgggatcttccagatcaacagccggaggtggtgcagcaacctcaccccgaacgtccccaacgtgtgccggatgtactgctcagatttgttgaatcctaatctcaaggataccgttatctgtgccatgaagataacccaagagcctcagggtctgggttactgggaggcctggaggcatcactgccagggaaaagacctcactgaatgggtggatggctgtgacttctaggatggacggaaccatgcacagcaggctgggaaatgtggtttggttcctgacctaggcttgggaagacaagccagcgaataaaggatggttgaacgtgaa

SEQ ID NO: 185430 - DNA, 972 bp, Homo sapiens
  Payload ID: 16519
  Gene Symbol: SPACA4
  Gene Name: sperm acrosome associated 4
  Uniprot ID: Q8TDM5
  ENST ID: ENST00000321762
  CDS Start-End: 237-611
ttccattcacagactcttgttgggcagcagccacccgctcacctccatccccaggacttagagggacgcagggcgttgggaacagaggacactccaggcgctgaccctgggaggccaggaccagggccaaagtcccgtgggcaagaggagtcctcagaggtccttcattcagcggttccgggaggtctgggaagcccacggcctggctggggcagggtcaacgccgccaggccgccatggtcctgtgctggctgctgcttctggtgatggctctgcccccaggcacgacgggcgtcaaggactgcgtcttctgtgagctcaccgactccatgcagtgtcctggtacctacatgcactgtggcgatgacgaggactgcttcacaggccacggggtcgccccgggcactggtccggtcatcaacaaaggctgcctgcgagccaccagctgcggccttgaggaacccgtcagctacaggggcgtcacctacagcctcaccaccaactgctgcaccggccgcctgtgtaacagagccccgagcagccagacagtgggggccaccaccagcctggcactggggctgggtatgctgcttcctccacgtttgctgtgaccaacagggaggacagggcctgggactgttctcccagatccgccactccccatgtccccatgtccttcccccactaaatggccagagaggccctggacaacctcttgcggccctggcttcatcccttctaaggctgtccaccaggagcccggtgctaggggaagcatccccaggcctgactgagcggcaggggagcacggcccgtgggtttgattgtattactctgttccactggttctaagacgcagagcttctcacatctcaatcaggatgcttctctccattggtagcactttagagtccatgaaatatggtaaaaaatatatatatatcataataaatgacagctgatgttcatgga

SEQ ID NO: 185431 - DNA, 648 bp, Homo sapiens
  Payload ID: 16520
  Gene Symbol: SPACA5
  Gene Name: sperm acrosome associated 5
  Uniprot ID: Q96QH8
  ENST ID: ENST00000304355
  CDS Start-End: 169-648
ggcagcaacagggttgcaggtgtaaaataacgggaaggcgggatgcgtggctaaattgctctgcgtgcacaaagagtaggagagcccagagttccagaatgcccctaattccgaacaccacagggtgagtctggagcaagtcacctgggagggcttacaggtgccataatgaaggcctggggcactgtggtagtgaccttggccacgctgatggttgtcactgtggatgccaagatctatgaacgctgcgagctggcggcaagactggagagagcagggctgaacggctacaagggctacggcgttggagactggctgtgcatggctcattatgagagtggctttgacaccgccttcgtggaccacaatcctgatggcagcagtgaatatggcattttccaactgaattctgcctggtggtgtgacaatggcattacacccaccaagaacctctgccacatggattgtcatgacctgctcaatcgccatattctggatgacatcaggtgtgccaagcagattgtgtcctcacagaatgggctttctgcctggacttcttggaggctacactgttctggccatgatttatctgaatggctcaaggggtgtgatatgcatgtgaaaattgatccaaaaattcatccatga

SEQ ID NO: 185432 - DNA, 571 bp, Homo sapiens
  Payload ID: 16520
  Gene Symbol: SPACA5
  Gene Name: sperm acrosome associated 5
  Uniprot ID: Q96QH8
  ENST ID: ENST00000376940
  CDS Start-End: 8-487
tgccataatgaaggcctggggcactgtggtagtgaccttggccacgctgatggttgtcactgtggatgccaagatctatgaacgctgcgagctggcggcaagactggagagagcagggctgaacggctacaagggctacggcgttggagactggctgtgcatggctcattatgagagtggctttgacaccgccttcgtggaccacaatcctgatggcagcagtgaatatggcattttccaactgaattctgcctggtggtgtgacaatggcattacacccaccaagaacctctgccacatggattgtcatgacctgctcaatcgccatattctggatgacatcaggtgtgccaagcagattgtgtcctcacagaatgggctttctgcctggacttcttggaggctacactgttctggccatgatttatctgaatggctcaaggggtgtgatatgcatgtgaaaattgatccaaaaattcatccatgactcagattcgaagagacagattttatcttcctttcatttctttctcttgtgcatttaataaaggatggtatctataaacaatgc

SEQ ID NO: 185433 - DNA, 595 bp, Homo sapiens
  Payload ID: 16521
  Gene Symbol: SPACA5B
  Gene Name: sperm acrosome associated 5B
  Uniprot ID: Q96QH8
  ENST ID: ENST00000304270
  CDS Start-End: 32-511
aagtcacctgggagggcttacaggtgccataatgaaggcctggggcactgtggtagtgaccttggccacgctgatggttgtcactgtggatgccaagatctatgaacgctgcgagctggcggcaagactggagagagcagggctgaacggctacaagggctacggcgttggagactggctgtgcatggctcattatgagagtggctttgacaccgccttcgtggaccacaatcctgatggcagcagtgaatatggcattttccaactgaattctgcctggtggtgtgacaatggcattacacccaccaagaacctctgccacatggattgtcatgacctgctcaatcgccatattctggatgacatcaggtgtgccaagcagattgtgtcctcacagaatgggctttctgcctggacttcttggaggctacactgttctggccatgatttatctgaatggctcaaggggtgtgatatgcatgtgaaaattgatccaaaaattcatccatgactcagattcgaagagacagattttatcttcctttcatttctttctcttgtgcatttaataaaggatggtatctataaacaatgc

SEQ ID NO: 185434 - DNA, 795 bp, Homo sapiens
  Payload ID: 16522
  Gene Symbol: SPACA7
  Gene Name: sperm acrosome associated 7
  Uniprot ID: Q96KW9
  ENST ID: ENST00000283550
  CDS Start-End: 68-655
gtcctggagaccaaggatgggaaactgtcaaccttcagaacgtccttctccctcagctggagggagcatggcagtgagccaaggagacgggaccctctgctttgtcctcctgctgtgctgttggcaagaaactgagctccggccgagaaccgtgattccaggttcacctactgaaataccattcagttcaaaacaggaggatatgtctgaattattagatgaaattctggtccaggagattttagatctgaataaaacaacaccgagcgaaatgccaagtacagcatcaacattatcaacaccgttacatgctggtattgatgagaattatcaagctggtggttctgagaattaccatgaattattagagaatttacaattctctcctggcattgaggtcaaaatttccaatgatgaagccaatgctaatgcaaatctccatggcgatccttctgagaattatcgtgggccacaggtgtctcctggcagtgagaagagtgtttccagtaaagaaaagaattcaaagaacactcagtatgaaaatctatccattctggaccaaatccttcaaaatattggaagatcttcaggaaacattttccataaagagcagcagaggaccagcgcacagaggaggagccaaggcagtcagtgaggccgcagccccagaccccctgcgcaggagaggagcctgctagaacccccacccaccagcctccggaacagggcacttgtgtgcacacgcccacgttctctgaaccattccacataaaggaaaatcgtttattcacacga

SEQ ID NO: 185435 - DNA, 807 bp, Homo sapiens
  Payload ID: 16522
  Gene Symbol: SPACA7
  Gene Name: sperm acrosome associated 7
  ENST ID: ENST00000375699
  CDS Start-End: 173-667
agtctcactctgttgccagactggagtgcagaggcgcctctcgatttcttgacctcatggtccgcccgcctcagcctcccaaagtgctgggactacaggcatgagccaccgtgcctggccaataacaccttaatcttcaggtgcaggctgtgaagatgggaaaaggctgtcaatgctctggcttcttcccactgacaggggacgtagtgggaatgggaatgaaccccaagatgaaattctggtccaggagattttagatctgaataaaacaacaccgagcgaaatgccaagtacagcatcaacattatcaacaccgttacatgctggtattgatgagaattatcaagctggtggttctgagaattaccatgaattattagagaatttacaattctctcctggcattgaggtcaaaatttccaatgatgaagccaatgctaatgcaaatctccatggcgatccttctgagaattatcgtgggccacaggtgtctcctggcagtgagaagagtgtttccagtaaagaaaagaattcaaagaacactcagtatgaaaatctatccattctggaccaaatccttcaaaatattggaagatcttcaggaaacattttccataaagagcagcagaggaccagcgcacagaggaggagccaaggcagtcagtgaggccgcagccccagaccccctgcgcaggagaggagcctgctagaacccccacccaccagcctccggaacagggcacttgtgtgcacacgcccacgttctctgaaccattccacataaaggaaaatcgtttattcacacga

SEQ ID NO: 185436 - DNA, 464 bp, Homo sapiens
  Payload ID: 16522
  Gene Symbol: SPACA7
  Gene Name: sperm acrosome associated 7
  ENST ID: ENST00000443541
  CDS Start-End: 130-464
ggcagtgagccaaggagacgggaccctctgctttgtcctcctgctgtgctgttggcaagaaactgagctccggccgagaaccgtgattccaggtctcgaggttcccaaagttcctggatctgccagcaaatgaccttcttcactcacctgtgggatggggacccggtgagccaggtagcaggttcacctactgaaataccattcagttcaaaacaggaggatatgtctgaattattagatgaaattctggtccaggagattttagatctgaataaaacaacaccgagcgaaatgccaagtacagcatcaacattatcaacaccgttacatgctggtattgatgagaattatcaagctggtggttctgagaattaccatgaattattagagaatttacaattctctcctggcattgaggtcaaaatttccaatgatgaagccaatgctaatgcaaatctccatgg

SEQ ID NO: 185437 - DNA, 699 bp, Homo sapiens
  Payload ID: 16522
  Gene Symbol: SPACA7
  Gene Name: sperm acrosome associated 7
  ENST ID: ENST00000414180
  CDS Start-End: 387-699
agaacgtccttctccctcagctggagggagcatggcagtgagccaaggagacgggaccctctgctttgtcctcctgctgtgctgttggcaagaaactgagctccggccgagaaccgtgattccaggtctcgaggttcccaaagttcctggatctgccagcaaatgaccttcttcactcacctgtgggatggggacccggtgagccaggtagcagagtctcactctgttgccagactggagtgcagaggcgcctctcgatttcttgacctcatggtccgcccgcctcagcctcccaaagtgctgggactacaggcatgagccaccgtgcctggccaataacaccttaatcttcaggtgcaggctgtgaagatgggaaaaggctgtcaatgctctggcttcttcccactgacaggggacgtagtgggaatgggaatgaaccccaaggttcacctactgaaataccattcagttcaaaacaggaggatatgtctgaattattagatgaaattctggtccaggagattttagatctgaataaaacaacaccgagcgaaatgccaagtacagcatcaacattatcaacaccgttacatgctggtattgatgagaattatcaagctggtggttctgagaattaccatgaattattagagaatttacaattctctcctggcattgaggtcaaaatttccaatgatg

SEQ ID NO: 185438 - DNA, 795 bp, Homo sapiens; identical to SEQ ID NO: 185434
  Payload ID: 16522
  Gene Symbol: SPACA7
  Gene Name: sperm acrosome associated 7
  Uniprot ID: Q96KW9
  ENST ID: ENST00000610393
  CDS Start-End: 68-655

SEQ ID NO: 185439 - DNA, 699 bp, Homo sapiens; identical to SEQ ID NO: 185437
  Payload ID: 16522
  Gene Symbol: SPACA7
  Gene Name: sperm acrosome associated 7
  ENST ID: ENST00000632976
  CDS Start-End: 387-699

SEQ ID NO: 185440 - DNA, 464 bp, Homo sapiens; identical to SEQ ID NO: 185436
  Payload ID: 16522
  Gene Symbol: SPACA7
  Gene Name: sperm acrosome associated 7
  ENST ID: ENST00000631374
  CDS Start-End: 130-464

SEQ ID NO: 185441 - DNA, 807 bp, Homo sapiens; identical to SEQ ID NO: 185435
  Payload ID: 16522
  Gene Symbol: SPACA7
  Gene Name: sperm acrosome associated 7
  ENST ID: ENST00000631817
  CDS Start-End: 173-667

SEQ ID NO: 185442 - DNA, 2007 bp, Homo sapiens
  Payload ID: 16523
  Gene Symbol: SPAM1
  Gene Name: sperm adhesion molecule 1 (PH-20 hyaluronidase, zona pellucida binding)
  Uniprot ID: P38567
  ENST ID: ENST00000223028
  CDS Start-End: 408-1937
acaggttaaatactgcagagctaatagattggagtgacttctgacctagtcacatcttaaaggaaaacttttcagtttttactttaaaaggatgctaatgactagccaatgctctaggaagacattgagaccagccaacttcttgccttgataactactgaagagacattgggtggctggattttgaaagcagacttctggttataggtgatgcaacttgaaaaacaatcctgaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacaatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctacaatgcttcaccctccacactatctgccacaatgttcattgttagtattttgtttcttatcatttcttctgtagcgagtttgtaattgcgcaggttagctgaaatgaacaatatgtccatcttaaagtgtgctttttcgactaattaaatctttg

SEQ ID NO: 185443 - DNA, 2349 bp, Homo sapiens
  Payload ID: 16523
  Gene Symbol: SPAM1
  Gene Name: sperm adhesion molecule 1 (PH-20 hyaluronidase, zona pellucida binding)
  Uniprot ID: P38567
  ENST ID: ENST00000340011
  CDS Start-End: 358-1893
aggtggttagcagcacctcataaggtccttcctagcaagggatgctaatgactagccaatgctctaggaagacattgagaccagccaacttcttgccttgataactactgaagagacattgggtggctggattttgaaagcagacttctggttataggtgatgcaacttgaaaaacaatcctgaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacaatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctacaatgcttcaccctccacactatctgccacaatgttcatttggaggctggaagtctgggatcaaggtattagcagaattggtttcttctgagagtcatgagggaaaaatgtgtttcaggcctcttcccttggcttacaggaaatgaaaaaaccatgactatcatcaccaacatccttgggtattaagtgcagtcactctcctagatgctgtggggagaaggcaagttacaaagatagaccttccctcaagataatcagattttcatggtattatccttaacctttttgacatcatggaggctttgggaatctgatgaagcctatcaattttcttccagaagatatttatataagattataagaaaaattatgtacacagcttattttattgcattggatcaaaatgccatttataaagaattatgccttttccatcaattttagcatggaaaaataatttcaggcaatatgcttaaaaattgggggaagacaaaagaaatccatatcgtgtaaataaaaataaattttggttttgctcaaaaataaa

SEQ ID NO: 185444 - DNA, 1860 bp, Homo sapiens
  Payload ID: 16523
  Gene Symbol: SPAM1
  Gene Name: sperm adhesion molecule 1 (PH-20 hyaluronidase, zona pellucida binding)
  Uniprot ID: P38567
  ENST ID: ENST00000402183
  CDS Start-End: 325-1860
tcaaagggatgctaatgactagccaatgctctaggaagacattgagaccagccaacttcttgccttgataactactgaagagacattgggtggctggattttgaaagcagacttctggttataggtgatgcaacttgaaaaacaatcctgaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacaatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctacaatgcttcaccctccacactatctgccacaatgttcatttggaggctggaagtctgggatcaaggtattagcagaattggtttcttctga

SEQ ID NO: 185445 - DNA, 760 bp, Homo sapiens
  Payload ID: 16523
  Gene Symbol: SPAM1
  Gene Name: sperm adhesion molecule 1 (PH-20 hyaluronidase, zona pellucida binding)
  ENST ID: ENST00000413927
  CDS Start-End: 520-760
ttccagttgtcctgagagtgatgactggctccaccttgatgtggctcacataaattcagaaagtatgatagcagtgtaggtggttagcagcacctcataaggtccttcctagcaaggttaaatactgcagagctaatagattggagtgacttctgacctagtcacatcttaaaggaaaacttttcagtttttactttaaaaggatgctaatgactagccaatgctctaggaagacattgagaccagccaacttcttgccttgataactactgaagagacattgggtggctggattttgaaagcagacttctggttataggtgatgcaacttgaaaaacaatcctgaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacaatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaa

SEQ ID NO: 185446 - DNA, 2220 bp, Homo sapiens
  Payload ID: 16523
  Gene Symbol: SPAM1
  Gene Name: sperm adhesion molecule 1 (PH-20 hyaluronidase, zona pellucida binding)
  Uniprot ID: P38567
  ENST ID: ENST00000439500
  CDS Start-End: 614-2143
atgggagaatggggaacgtggaggtaaaggagggaacctaatgtaagaatactgaatttgccaattaaggcaccagctgtgactacttcatacaggaatggggacatgcctgatgccatagggtctaattgacttgagaatgtgaaaggaaaataaaaactcagaaccccaattcatcatgccaaaaggaaaaaaaaattaagctgaaatgttaaatactgcagagctaatagattggagtgacttctgacctagtcacatcttaaaggaaaacttttcagtttttactttaaaaggatgctaatgactagccaatgctctaggaagacattgagaccagccaacttcttgccttgataactactgaagagacattgggtggctggattttgaaagcagacttctggttataggtgatgcaacttgaaaaacaatcctgaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacaatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctacaatgcttcaccctccacactatctgccacaatgttcattgttagtattttgtttcttatcatttcttctgtagcgagtttgtaattgcgcaggttagctgaaatgaacaatatgtccatcttaaagtgtgctttttcgactaattaaatctttgaaaagaa

SEQ ID NO: 185447 - DNA, 2154 bp, Homo sapiens
  Payload ID: 16523
  Gene Symbol: SPAM1
  Gene Name: sperm adhesion molecule 1 (PH-20 hyaluronidase, zona pellucida binding)
  Uniprot ID: P38567
  ENST ID: ENST00000460182
  CDS Start-End: 548-2077
gatagcagtgtaggtggttagcagcacctcataaggtccttcctagcaaggtaacagtacaagctttttctaaaaatcttgatgtatacctgatctcctggttgaaagagttggcttgatggattttttcctataagttctttttatgtctagatttttatgttccacttgacctgatgattgaggatggtatgaagtaagaagttttaatgagtaatccagagattttggatgctaatgactagccaatgctctaggaagacattgagaccagccaacttcttgccttgataactactgaagagacattgggtggctggattttgaaagcagacttctggttataggtgatgcaacttgaaaaacaatcctgaaacatgaaacaagaataataatatttaaatgtaacttaatcattatacctctttatccatcaaagtgaattcattccattccctttcatctgtgctcatactttgcatcagatattgggtaaaccaaagtgtgtaggaagaaataaatgttttcatagtcattactctttacaatgggagtgctaaaattcaagcacatctttttcagaagctttgttaaatcaagtggagtatcccagatagttttcaccttccttctgattccatgttgcttgactctgaatttcagagcacctcctgttattccaaatgtgcctttcctctgggcctggaatgccccaagtgaattttgtcttggaaaatttgatgagccactagatatgagcctcttctctttcataggaagcccccgaataaacgccaccgggcaaggtgttacaatattttatgttgatagacttggctactatccttacatagattcaatcacaggagtaactgtgaatggaggaatcccccagaagatttccttacaagaccatctggacaaagctaagaaagacattacattttatatgccagtagacaatttgggaatggctgttattgactgggaagaatggagacccacttgggcaagaaactggaaacctaaagatgtttacaagaataggtctattgaattggttcagcaacaaaatgtacaacttagtctcacagaggccactgagaaagcaaaacaagaatttgaaaaggcagggaaggatttcctggtagagactataaaattgggaaaattacttcggccaaatcacttgtggggttattatctttttccggattgttacaaccatcactataagaaacccggttacaatggaagttgcttcaatgtagaaataaaaagaaatgatgatctcagctggttgtggaatgaaagcactgctctttacccatccatttatttgaacactcagcagtctcctgtagctgctacactctatgtgcgcaatcgagttcgggaagccatcagagtttccaaaatacctgatgcaaaaagtccacttccggtttttgcatatacccgcatagtttttactgatcaagttttgaaattcctttctcaagatgaacttgtgtatacatttggcgaaactgttgctctgggtgcttctggaattgtaatatggggaaccctcagtataatgcgaagtatgaaatcttgcttgctcctagacaattacatggagactatactgaatccttacataatcaacgtcacactagcagccaaaatgtgtagccaagtgctttgccaggagcaaggagtgtgtataaggaaaaactggaattcaagtgactatcttcacctcaacccagataattttgctattcaacttgagaaaggtggaaagttcacagtacgtggaaaaccgacacttgaagacctggagcaattttctgaaaaattttattgcagctgttatagcaccttgagttgtaaggagaaagctgatgtaaaagacactgatgctgttgatgtgtgtattgctgatggtgtctgtatagatgcttttctaaaacctcccatggagacagaagaacctcaaattttctacaatgcttcaccctccacactatctgccacaatgttcattgttagtattttgtttcttatcatttcttctgtagcgagtttgtaattgcgcaggttagctgaaatgaacaatatgtccatcttaaagtgtgctttttcgactaattaaatctttgaaaagaa

SEQ ID NO: 185448 - DNA, 3948 bp, Homo sapiens
  Payload ID: 16524
  Gene Symbol: SPECC1
  Gene Name: sperm antigen with calponin homology and coiled-coil domains 1
  Uniprot ID: Q5M775
  ENST ID: ENST00000261503
  CDS Start-End: 52-3258
agaagcagaaaaggttggataaaagataaggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactgccggagccatctcggagctcacggagagccgcctgaggagcggcacaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtggagctggacagaatatttctgtccataagacccccagaagtcccctaagtgggataccagtgaggactgctccagcagctgctgtctctccaatgcagaggcattcgacttacagcagtgtgcggccagccagcagaggggtgactcaacgcttggaccttcctgaccttcccctctcagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcagtgtggaaagaaaagaccctctggcagccttggcccgggaatacggtggttccaagcgcaatgctctactgaaatggtgccagaagaagacacaaggttatgcgaacattgacatcaccaatttcagcagcagctggagcgatggcctggccttctgtgctctgctccacacctacctgcctgcccacatcccctaccaggagctgaatagtcaggagaaaaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaacaacaaaacacaaaaaataaacatttgttccagggcaacctggaaa

SEQ ID NO: 185449 - DNA, 2982 bp, Homo sapiens
  Payload ID: 16524
  Gene Symbol: SPECC1
  Gene Name: sperm antigen with calponin homology and coiled-coil domains 1
  Uniprot ID: Q5M775
  ENST ID: ENST00000395522
  CDS Start-End: 115-2226
ctggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctgctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaagtacaagtcttatgaaaagttatttgcagctggagtgctgaaaagggcacagtggcagagcagatgcagagctgggtacagcgcaggcccgagttcttttgttttttgttgttgttgttgttgttgttttgttttgttttttttttttttttgagacagagtttcactcttgttgcccaggctggagtgcaatggtacgatctcggctcactgcaacctctgcctcccgggttcaagtgattctcttgcctcagccttccaagtagctggaattacaggcgcctgccaccacacccagctaatttttgtattgttagtagagatggggtttcaccgtgttggccaggctgctcttgaactcctgacctcaggtgatccccacctcagcctcccaaagtgctgggattacagacatgagccaccgcacccag

SEQ ID NO: 185450 - DNA, 2536 bp, Homo sapiens
  Payload ID: 16524
  Gene Symbol: SPECC1
  Gene Name: sperm antigen with calponin homology and coiled-coil domains 1
  Uniprot ID: Q5M775
  ENST ID: ENST00000395525
  CDS Start-End: 109-2238
cggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaa

SEQ ID NO: 185451 - DNA, 3363 bp, Homo sapiens
  Payload ID: 16524
  Gene Symbol: SPECC1
  Gene Name: sperm antigen with calponin homology and coiled-coil domains 1
  Uniprot ID: Q5M775
  ENST ID: ENST00000395527
  CDS Start-End: 84-3290
atcagtgagcgcccggagccgtggccgctgggggttgcggcggcgctgagccagcggggccggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactgccggagccatctcggagctcacggagagccgcctgaggagcggcacaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtggagctggacagaatatttctgtccataagacccccagaagtcccctaagtgggataccagtgaggactgctccagcagctgctgtctctccaatgcagaggcattcgacttacagcagtgtgcggccagccagcagaggggtgactcaacgcttggaccttcctgaccttcccctctcagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcagtgtggaaagaaaagaccctctggcagccttggcccgggaatacggtggttccaagcgcaatgctctactgaaatggtgccagaagaagacacaaggttatgcgaacattgacatcaccaatttcagcagcagctggagcgatggcctggccttctgtgctctgctccacacctacctgcctgcccacatcccctaccaggagctgaatagtcaggagaaaaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccac

SEQ ID NO: 185452 - DNA, 4971 bp, Homo sapiens
  Payload ID: 16524
  Gene Symbol: SPECC1
  Gene Name: sperm antigen with calponin homology and coiled-coil domains 1
  Uniprot ID: Q5M775
  ENST ID: ENST00000395529
  CDS Start-End: 53-2425
aagaagcagaaaaggttggataaaagataaggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactgccggagccatctcggagctcacggagagccgcctgaggagcggcacaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaacaaagtacaagtcttatgaaaagttatttgcagctggagtgctgaaaagggcacagtggcagagcagatgcagagctgggtacagcgcaggcccgagttcttttgttttttgttgttgttgttgttgttgttttgttttgttttttttttttttttgagacagagtttcactcttgttgcccaggctggagtgcaatggtacgatctcggctcactgcaacctctgcctcccgggttcaagtgattctcttgcctcagccttccaagtagctggaattacaggcgcctgccaccacacccagctaatttttgtattgttagtagagatggggtttcaccgtgttggccaggctgctcttgaactcctgacctcaggtgatccccacctcagcctcccaaagtgctgggattacagacatgagccaccgcacccagaacctaaggcccaagttctactttttggtgttcatttctctgcttccttttgatcgtggtgtctgatcatcttggaattcacattactcaaggcaaaataggaagccatctgcgtgatgtcacattccgaagaagtcagaaggttcggcgagttggagctttactcttgttgcccaggctagagtgcagtggtgcgatcttggctcattgcaagctccgcttcctgggtttaagctattctcctgccttggcctcccaagtagctgggattacaggcatgtgccgtcactcctggctaattttgtatttttagtagagatgcaatttcaccatgttggtcaggctggtctcgaactcctgacctcaagtgatctggccgcctcagcctcccaaagtgctgggattacaggcttgagaccccatgtctggccccttctgtggggtcttgattgagccccttcacttggagtctgacttcattacctcgtctgaaacaaggtgcctccaagctttgggttgatttccagaatcttgttgggttaaacataagtagaagtttgatcataaaggatgttattaagccggataggtaagcacggtgacaatggcaatagaaatctaatggaaaacgattgaatgacaactacaccaaagtttcatggatgaaactcaccccagaaacttagtgttcaaatcagagtgatacacaattcaaaatgtgattttaaacttctggaaatatgtgtgtttgtgaagatccaaatccaattcagcaacctccatcaggcagaaaccttctgcaatcctcacatgaggaactggttcacagtgtacacagcatggagccattagtgacgttatccaaaggatgagacaagacaaaagttactgtctaataaaaggaaaattaggaacaggaatgctctttaaactcaggaagatcttttggggtgtcaaactggacagcacagaatcattagaaaaattagcttggcgtgagaagagacattgaggtcttctctgtaaaatttacttagatacttgtgaataggactgaaatttatattttgggcactctttacctcagattcagagttcttaggattatttaaaattcatttgctggatgttttcaagtataaacaataagaaaactgcaacttcaacttaaaaggcactgctgtatttgcaccctatattttgacctgtcgttaggtactgttgaatatttttatctgtaagcatttatgaagtgcaaaataaacatgttattatatagaagcgtctgctgcttagttttaatcaccagctacgtttctgcagggcctttatgtcgttttgttctacatttttttctgaatacagtttcagaacttcaaagtcacatcaagtaactagaatttgaggtagaaaaaagctggatgtaagttgtaaataggaggttgacatggaatatgaacagtttcattagtagaacaaaagggcatggagtaaaaatgctaattttgcataaatttttaaaactctagggtctcagaaaatatagcatggacttaaagtctagatgtgttttgttgacatttaaatatgaatagattgatgatttaatgtattggattttttcttaattatgaagtattatttaggtatactaataacaaaatggagacgtgtgaagaaaaatattaatctttcttctccctcagtaccacctgtgaggaaatcagtgttaacagtgtgtacatttttctttactcatgaatatgtatagggttcattttcatatttttaataaaaattggattatattcttttca

SEQ ID NO: 185453 - DNA, 8133 bp, Homo sapiens
  Payload ID: 16524
  Gene Symbol: SPECC1
  Gene Name: sperm antigen with calponin homology and coiled-coil domains 1
  Uniprot ID: Q5M775
  ENST ID: ENST00000395530
  CDS Start-End: 209-3172
gatgcagatgagggggcggggcccacgggcgcgggagagcagcggctccgccggcagctgctgggaactggaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggggcctttacaacaactaaacggacaggcattccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactcaacattcagcagcagttgacctgtagcttgcggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtggagctggacagaatatttctgtccataagacccccagaagtcccctaagtgggataccagtgaggactgctccagcagctgctgtctctccaatgcagaggcattcgacttacagcagtgtgcggccagccagcagaggggtgactcaacgcttggaccttcctgaccttcccctctcagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcagtgtggaaagaaaagaccctctggcagccttggcccgggaatacggtggttccaagcgcaatgctctactgaaatggtgccagaagaagacacaaggttatgcgaacattgacatcaccaatttcagcagcagctggagcgatggcctggccttctgtgctctgctccacacctacctgcctgcccacatcccctaccaggagctgaatagtcaggagaaaaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaacaacaaaacacaaaaaataaacatttgttccagggcaacctggaaacgtgcgtgcgcactcagccttttggggaaaaatgggagttctaggtaacaatgttaacacctggaacttgattcacttttagctctcaccatcccttatttgatttattgtagcaaaaggaaagcctgtgagaatgcaagggagcccctggctgctttgctggagtccctgggaggtgccccacacctctgccaccaaagtctgtgtgctcctgagcagctcgcggctttcacagtagggaaaccgcagtcctcgtcacctgcgcctttgtcctcccattcgtttaccctcccgttcacatccacacaggcttgtaccccacagaacttgacaggaggtcacatgtgtgaatggcctgtgtctgctttacagggttgagcaggctgagggtgtgtgcctctggggatgctgggctgacagcaaatcccaacagtatttcggctctggactgatttggcctttagtgcttccccaggcctctttcatcggcatgggaaaagcccttaggggtgggcggtgagggcacatttataactaacaaagaagaatgcagttgccccagcatcctactggtcaccttaagtggcagcagagccctccccagcggtgccccagtccctcagaagtgctcagtccggcccgagtgcccatctggtggctctgccgtgttcttctgggcggatctgtgtgcactacacagcgagtgagggcgtggctcacacagttgtttgagggaaatgggtaatgcccatcccttgctgttttaagtgccaaatagcgtgttagcgcccctccaacaaaggatcatccttccagtgagtcaccgagaatgacagtgactgccattactattcaaagtacatctctgattgctgatctgagccactggttcagagccaggttctagaggctgcaggtccagccccttaccattcctggagaggtaggagctcagtcccttcctccaagccagacctttgcagaggtggcaactgggctgcacgggtcagcagatccctgattctcaagccaccttgagacaagaactccgcccccctgttagtgcatcccagctgcagctctgcatcagaacctacagtggacccttttgaaaacactcttggctgccctagttggttaacttcagaatgtctggaatgggaccagagatgcagttcacatgttttgtaagttctttaggcgactgaagcacagctgcttggagaaccactgaggggtggacaccttcccctggcagccacaaggcaggcagcctgcgggagctcctgagcagctgttgggcgatggtcattacatcacccatgcctttgtatttaaatgaaactcgacacatagaaccaattcaacctgaaagttactacttctgctgattcaggcacttgtttgaagcattttttttttattaaccctgtacttcttctttgcccaccattaaagtgggggaaagtaatatcccaagtagttgagttgagctgttggttgttagatttaagctggaattagtccagggttttatgtggggaggcagttgctgtcttgggatacccggagtgggagtgggtgttttctgtgattggttctgttttttatttttacttatttattttgagatggagtttcatccttattgcccaggctggagggcaatagcaccgtctcagctcactgcaacctccgccgcccgtgtttaagcgattctcctgcctcagcctcccatgtggctgggattacaggtgcccatcaccacacccagctaatgtttttgtatttttagtaaagagggggtttcaccatgttggcccggctggtctcgaactcctgatggcaaggtgatctgcctgcctcagcctcccaaagtgctgggattacaggcatgagccactgagcccggctgtttttttgtgttttttttgttgttgtttgtttgtttttttttttgagacagagtcttgctctgtcgcccaggctggagtgccagtggcgcgatttcagctcactcaggagtgagccaccacacctggcctgtgattggctctattttgagtgattacgtgtaaatcatctagaaccagctctgagcaatggcgttgcggtgtccctccctccccgctggggccataccagcccctctccactgggagcccaagttgccaatgactgtggccaaactcccccatttttgtctgtatcctgctctctttaggttaaaaagaaggaaagaaacatgaaaggccatgtacaatttatttttacaactccaggagtttccccgactaccattttttttttttttatttgccagtggtgtgcatgtagaagaggaatgccatgtcctgtccatagaaatacacatggtggtcaggcatggtggctcatgcctataatcccagcactttgggaggctgaggtgggaggattgcttgagcccaggagtttgagaccagcctgggcaacatggcaagacctctgactctataaaaaaatttttttttttttttttttttgagagagcgtctcacttctctgtcacccaggctagagtagtgtgatcttggcttattacaacttccgcctcccaggttcaagagattctcctgccttagcctcctaagtagctgggattataggcacatgccaccatgcctggcatatttttgtatttttagtagaaacagtttcaccatgttggccaggctggtcttgaactcctgacctcaagtgataagcctgcctcaacctcccaaagtgctgggactacaggggtaagccaccgcgcctggcccaaaattttgttttttaattagctgggtacaatgataggcacctgtaatctcagctgcttgggaggctgaggtgggagcatcacttgagcccaggagtttgaggctgcagtaagctgtgtttgtgccactgcactctggcctgggccaaagagcaagaccctgtcacacacacacacaaaaaaaagaaatacaggtggtgttttggggaagggaaggttctgctggggtcctggaactgtgactgatggcctcaggagtccaggaataggccttctagcacagcagctagtagggctcccccaagccatccgctggcgtgtggaggtgcaggacctgggggaggcagtccccaacccagctaggccaaggggtagggtttttaggtctgtttttaacagagctcagagcaccaggtgaaggtggaaagttggcaggaaaacaaggtcagcatcttattttttctatactcagcagagtgtgccattcccagtttctgtcctgaggatttcaaagaccacaacagccacatttctttccatcttccctcagccagtagtcatttaaaattcttcagttgttctgaagatcctttttttaatgtatcatttttacatgaaagacagctgcaaaatgcaagccccagtagagttggagagtttttcaaggtgagaagtcgctgttctctgcattgaacatggattgaattttccttgtctgatggtaacccatggcccccgccctgcggggataacattctcaggagcttctcttgtcctagccccttctcatttcaaaaatattagtcttttattttcctttttcattcagtttttgttttacagcttttgtagagaccaacccaagtagatgcaggtgggtgttagataaaaacacacatccccaggggacaagccatccagcggtgaggaatctctgccatgttctcttccctgctgcccacaaacgttacggagactcccttagcctccccctcctcttccccactgaggggcagcttgtggagatggaggactcgggcccatagatgcagaccccctaccaaatctagcaatagttctcacccttccaaagctcgagtgccattttgagatgacctaccaatgacatgcagtaaaggacataacctcacagcctttttagaagcatttcgaatatctacagttgcctcaattcacggggcatttcactcctctgatccaggttagaattttgctaaatctgtagcatcctgaatagcacactaatttttttttttagcacactaactttaactacattagttgagtgtagttgatacatctgtggcctcgtgtctataaagagcacactagattgtacccagcacttttggatatgacatgctaattagatgtatttaactattcataggaaagtgtatgataaatgactgtaatatttctaataaatatattttgtttctaatta

SEQ ID NO: 185454 - DNA, 571 bp, Homo sapiens
  Payload ID: 16524
  Gene Symbol: SPECC1
  Gene Name: sperm antigen with calponin homology and coiled-coil domains 1
  ENST ID: ENST00000583528
  CDS Start-End: 338-571
agtgagcgcccggagccgtggccgctgggggttgcggcggcgctgagccagcggggccggcgtagcgtgcctcctgtgattgttgaagagctgtggtgtgctgctgagtggcgtgtgtattccatgtgaggggaagggtccaacagtcctggtcattcagactgcagttccccagagacagagttttgctatgttgctcaggctggtcttgagctcctggcctcaagcaatccacctgccttggcctcccaaagtgctgagattacagatgtgagccaccacacccagtccaagtgtttctatttagttgataatggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccact

SEQ ID NO: 185455 - DNA, 462 bp, Homo sapiens
  Payload ID: 16524
  Gene Symbol: SPECC1
  Gene Name: sperm antigen with calponin homology and coiled-coil domains 1
  ENST ID: ENST00000580934
  CDS Start-End: 242-462
gtgagagtggcagttagaattggttgtcacttgtgggtgttttgtaaagtgcatttctgatgttctttgaaaggacagaacatcatgggtttggtgccctgtgtcacaccctgagtccatggggacaggcggagtcagggttggggctggaagagaaccgagagggcatttaatccagtcctgttatgttattgacagaagaaacagaggctctgagagggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaa

SEQ ID NO: 185456 - DNA, 732 bp, Homo sapiens
  Payload ID: 16524
  Gene Symbol: SPECC1
  Gene Name: sperm antigen with calponin homology and coiled-coil domains 1
  ENST ID: ENST00000582226
  CDS Start-End: 1-503
aagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttggagaataaaatgaagttctgaaaaaaac

SEQ ID NO: 185457 - DNA, 433 bp, Homo sapiens
  Payload ID: 16524
  Gene Symbol: SPECC1
  Gene Name: sperm antigen with calponin homology and coiled-coil domains 1
  ENST ID: ENST00000578321
  CDS Start-End: 377-433
ctccctgttgtgccttgggggtgctgcgtggtgcagaggaccgagaagcccttcgccctcggcgtccgccgcgctcccgccccttcctggccggggtgacaggggaagggctagggctgcgcatcccgggtcagctggggcgccgcggcgcagtgcacctggaaggcccgggggcagcgcgcggtgcccgtgggtttcccggtggtgcggacctgcgggcgtgcggaagtaacgacctccttccccagtgcccatgcaaggaaattagtgttatgtgcttgctttttttttttttttttcctaaggaagtttgactctgaatatcttattttgctggagctccatttgccagcacgacagacccacgaagtcaagcatgcggagtgcagccaagccctggaacccagccatcagagcagggggccacggccca

SEQ ID NO: 185458 - DNA, 2249 bp, Homo sapiens
  Payload ID: 16524
  Gene Symbol: SPECC1
  Gene Name: sperm antigen with calponin homology and coiled-coil domains 1
  ENST ID: ENST00000581399
  CDS Start-End: 1-1604
ggaaggttgaggaagaaaaccaaggagctttagaaatgattaaacgtctgaaggaagaaaatgaaaaactgaatgagtttctagaactggaacggcataataataacatgatggccaaaactttggaagagtgtagagttaccttggaagggctaaaaatggagaatggatctttgaagtctcatttgcagggtgagaagcagaaagccacagaggccagtgctgtggagcagacggcagagagctgcgaagttcaagaaatgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccacctgtggatgaagagccagagtcctctgaggtcgatgctgctggtcggtggcctggtgtctgtgttagcagaacatctccaacacccccagagtcggcaaccaccgttaagtcacttatcaagtcatttgacttgggacgcccaggtggagctggacagaatatttctgtccataagacccccagaagtcccctaagtgggataccagtgaggactgctccagcagctgctgtctctccaatgcagaggcattcgacttacagcagtgtgcggccagccagcagaggggtgactcaacgcttggaccttcctgaccttcccctctcagatattctaaagggaaggactgagaccctgaagccagacccccacctccgcaagagtccctcactagagtcactgagcagacccccgtctctgggctttggggacacaagactgctgagtgcttccacccgggcatggaaaccacaaagcaaactcagtgtggaaagaaaagaccctctggcagccttggcccgggaatacggtggttccaagcgcaatgctctactgaaatggtgccagaagaagacacaaggttatgcgaagaggaatctcttgttggcatttgaagcggctgaaagtgtaggcatcaaacccagcctggaactcagcgagatgctgtacacagaccggcccgactggcagagtgtgatgcagtacgtggcccaaatctacaagtactttgagacgtaaccctggagggcctggggcagccaccattgccacctactgcagcttttcctggaagcgcctgattactgtccactgaccctgctctgcccaccacccagctgcctagacttcaaagacaggctcaatccaagtggaccaacacccaaataagaaacagagtgggtcccacgatgtacctgtctgaaatgcaaatgcagctggactgtaaattggggactctttgatctcttgtgggatgcttctaaagagggcagcctccctccttccagaccaagaccccacacccaggcttgttttgctgattatattgggtggctgaacgaacacattatctgcagaaattcagacaaagaacatctccaaatcagtcttttggttgctgttgttaaaaatatcccggctttgcctttatgaaacctttgcccttggctgggtgtggtagctcgtggctgtaatcccagcactttaggaagccaaggcagtaggatcgtttgagcccaggagttcgaggctgcagtgagctatgagcataccactgcactccagcctgtgtgaaagagccagaccctgtctcaaaaaaatgataaaacccaaaactttgcccttgtgaaccctcccttcccccctccccccccaaaaaaaaac

SEQ ID NO: 185459 - DNA, 195 bp, Homo sapiens
  Payload ID: 16524
  Gene Symbol: SPECC1
  Gene Name: sperm antigen with calponin homology and coiled-coil domains 1
  ENST ID: ENST00000578153
  CDS Start-End: 1-140
tgcctgcccacatcccctaccaggagctgaatagtcaggagaaaaagaggaatctcttgttggcatttgaagcggctgaaagtgtaggcatcaaacccagcctggtacgtatcctattttgtatccttgtgatactttaattgtatgagaaatgactttatgccatctgataaacagtttctcgtagaacattga

SEQ ID NO: 185460 - DNA, 570 bp, Homo sapiens
  Payload ID: 16524
  Gene Symbol: SPECC1
  Gene Name: sperm antigen with calponin homology and coiled-coil domains 1
  ENST ID: ENST00000583482
  CDS Start-End: 268-570
tcagtgagcgcccggagccgtggccgctgggggttgcggcggcgctgagccagcggggccgatgtagattccaatgatgtcatctcactgaaacctccgcctcccaggttcaagtgatcctcctgcctcagcctcccaagtagctgggactacaggtgcacaccaccacgcccagctgatttttgtatttagtagagacaggatttcaccatgttagccagactggtcttgaactcctgacctaaggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactgccggagccatctcggagctcacggagagccgcctgaggagcggcacaggggcctttacaacaactaaa

SEQ ID NO: 185461 - DNA, 731 bp, Homo sapiens
  Payload ID: 16524
  Gene Symbol: SPECC1
  Gene Name: sperm antigen with calponin homology and coiled-coil domains 1
  ENST ID: ENST00000467722
  CDS Start-End: 204-281
agatgagggggcggggcccacgggcgcgggagagcagcggctccgccggcagctgctgggaactggaaggcgcccggtcctttctttgactggagcggacccgccggacgcaaccgcctcgccagccggagccagcgcgagctcggcacggtggacacccggtccgaggccggcaagccggctggtgcccgagtcggccaagcatgggcaaccactcaggacggcccgaggatccggaaccaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctcc

SEQ ID NO: 185462 - DNA, 940 bp, Homo sapiens
  Payload ID: 16524
  Gene Symbol: SPECC1
  Gene Name: sperm antigen with calponin homology and coiled-coil domains 1
  ENST ID: ENST00000584527
  CDS Start-End: 1-609
atgttgaaagtagcccgagcagagaaagatctactggaactgtcttgcaatgagctcagacaagaattactaaaggcaaacggtgaaattaaacatgtttccagtctgctggccaaggtggaaaaggattattcatacctgaaggagatatgtgatcaccaagccgaacagctgagcagaaccagcctaaagctgcaagaaaaagcatcagagagtgatgcagagatcaaagacatgaaagaaaccatatttgaattggaagatcaggtggaacagcaccgggctgtcaagttacacaataatcaactcatcagtgagctagaaagtagtgtgatcaagctggaggaacagaagtcagacctggagaggcagctgaagactctgaccaagcagatgaaggaggagaccgaggaatggaggcggttccaggcggatctgcagaccgcagtggtggtggccaatgacatcaagtgtgaggcccagcaggagctgcgcaccgtgaagaggaaactgctggaggaggaggagaagaatgcccggttgcagaaggagctgggggatgtgcagggccacggcagggtggtcaccagcagagccgcccctccgtgagtctggtgggcaccagggccgtgcttgcttctcaatcactatctccctgggctctgtcagctagcagagcatttggtggaagaaagacagcccagctcttgccatgattgggagccgcagccatctctagatgaaagggggaatgtgtagaggagaaattgcctctttataaagagcccagttgtctccttgtgacattctctgtttctcagagtcattgccgtcgagtctctgctttttgtccacattttgggatcagcttactgcatgatcaaagatgatgtttccctctttttacttttcctcagaagattgagctgtcttttatttg

SEQ ID NO: 185463 - DNA, 674 bp, Homo sapiens
  Payload ID: 16524
  Gene Symbol: SPECC1
  Gene Name: sperm antigen with calponin homology and coiled-coil domains 1
  ENST ID: ENST00000581973
  CDS Start-End: 368-674
tgtgagagtggcagttagaattggttgtcacttgtgggtgttttgtaaagtgcatttctgatgttctttgaaaggacagaacatcatgggtttggtgccctgtgtcacaccctgagtccatggggacaggcggagtcagggttggggctggaagagaaccgagagggcatttaatccagtcctgttatgttattgacagaagaaacagaggctctgagagggtgagggatggaccaggccgctccttgctcaggaatcacagtgccggtccctgctggccagtctcgggctgccttccacatctctgtgtggattttcccctgatgtcttcagctgtatcttgctggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactgccggagccatctcggagctcacggagagccgcctgaggagcggcacaggggcctttacaacaactaaacgga

SEQ ID NO: 185464 - DNA, 581 bp, Homo sapiens
  Payload ID: 16524
  Gene Symbol: SPECC1
  Gene Name: sperm antigen with calponin homology and coiled-coil domains 1
  ENST ID: ENST00000583463
  CDS Start-End: 184-581
agccgtggccgctgggggttgcggcggcgctgagccagcggggccggcgtagcgtgcctcctgtgattgttgaagagctgtggtgtgctgctgagtggcgtgtgtattccatgtgaggggaagggtccaacagtcctggtcattcagactgcagttccccaggacagacccacgaagtcaagcatgcggagtgcagccaagccctggaacccagccatcagagcagggggccacggcccagaccgggtgcggcctctgcctgcagcctcttccggcatgaagagttctaagtcttcaacttccttggcttttgagtcccgactcagcaggctcaagagggccagcagtgaggacacgctcaacaagccaggaagtaccgctgcatcgggggtggttcgcctgaagaagaccgccactgccggagccatctcggagctcacggagagccgcctgaggagcggcacaggggcctttacaacaactaaacggacaggcattccagccccacgggaattttcagtaactgtctcaagagagaggtctgtgccacgtggtccctccaaccccaggaaatcagtgtc

SEQ ID NO: 185465 - DNA, 662 bp, Homo sapiens
  Payload ID: 16524
  Gene Symbol: SPECC1
  Gene Name: sperm antigen with calponin homology and coiled-coil domains 1
  ENST ID: ENST00000582604
  CDS Start-End: 599-662
ggtaacgtgctgcggtcgcattccgcgctgctgaaggtttgtccttttgatgtttggaatgcgttcttattactgctcactctttgggtctgcactgtctatatgagctgcaacacacacctcgaaggtctgcagcttcactcctgaagctagcgagaccacgaactcaccaggaggaacgaacaactctagatgcgcccccttaagagctgtaacactcgccgcgaaggtctgcagcttcactcctgagtcagcgagactacgaacccaccagaaggaagaaactccgaacacatccaaacatcagaaggaacaaactccagacacaccgcctttaagaactgttacgctcaccgcgagggtccacggcttcattctccaagtcagaccaagaacccaccaattccggacacaaaaggtgttcccaccattcctgtcctcttacttctctcgccttacaagcgtagcgtgcctcctgtgattgttgaagagctgtggtgtgctgctgagtggcgtgtgtattccatgtgaggggaagggtccaacagtcctggtcattcagactgcagttccccaggacagacccacgaagtcaagcatgcggagtgcagccaagccctggaacccagccatcagagcagggggccacggcccagaccggg

SEQ ID NO: 185466 - DNA, 6756 bp, Homo sapiens
  Payload ID: 16525
  Gene Symbol: SPECC1L
  Gene Name: sperm antigen with calponin homology and coiled-coil domains 1-like
  Uniprot ID: Q69YQ0
  ENST ID: ENST00000314328
  CDS Start-End: 286-3639
ggaggccgggcggcccggcaagcggcgctgcggggtaggctgctttcctgaggccggactcaacgggtctcggctgagccaccgggtgagctcaccgcccagcccaaaccaggagattgcgagggagcgatgcggtgcagcgcgtgttcttggggaagatcccgactaagccattttccagtggcacctcttccatcatgagttcctgaggcagtccgatggggctactttattccagaacaatcacaatttgcttgtaaatgcatcacgaagaggcagcccagaatgaagaaagcaagcaggagtgttggctcagtgcctaaagtgtctgcaataagtaaaacgcaaacagcagaaaaaattaaacctgaaaacagctcttcagcatctacgggaggcaaacttgtaaaacctggaacagcagcatcattgtcaaagaccaagagcagtgatgaccttttagctggaatggccggaggggtaacggtgactaatggtgttaaaggaaagaaaagcacctgcccatctgcagcaccttcagcatctgcccctgccatgaccaccgtggagaacaaatccaagattagcacaggcacagcttcttcaaccaagcggagcacttctacaggtaataaagaatccagttctactagagaaagattacgtgaacgtacccgattaaaccagagcaaaaaactaccttctgcaggtcagggagctaatgacatggcattggccaaacgttcccgcagtcgaactgctacagaatgtgacgttcgtatgagcaagtctaagtcagacaatcagatcagtgacagagctgctttggaggccaaagtgaaggatcttctcacgctggcaaaaaccaaagacgtagaaattttacatttgagaaatgaactgcgagacatgcgtgcccagctgggcattaatgaggatcattctgagggtgatgaaaaatctgagaaggaaactattatggctcaccagccgactgatgtggagtccactttattgcagttgcaggaacagaatactgccatccgtgaagaactcaaccagctgaaaaatgaaaacagaatgttaaaggacaggttgaatgcattgggcttttccctagagcagaggttagacaattctgaaaaactgtttggctatcagtccctgagcccagaaatcacccctggtaaccagagcgatggaggaggaactctgacttcttcagtggaaggctctgcccctggctcagtggaggatctcttgagtcaggatgaaaatacactaatggaccatcagcacagtaactccatggacaatttagacagtgagtgcagtgaggtctaccagcccctcacatcgagcgatgatgcgctggatgcaccatcctcctcagagtcggaaggcatccccagcatagagcgctcccggaaggggagcagcgggaatgccagtgaagtgtccgtggcttgcctgactgaacggatacaccagatggaagagaaccaacacagtacaagtgaggaactccaggcaaccctgcaagagctagctgatttacagcagattacccaggaactgaatagtgaaaacgaaaggcttggagaagagaaggttattctgatggagtctttatgtcagcagagcgataagttggaacactttagtcgacagattgaatacttccgctctcttctagatgagcatcacatttcttatgtcatagatgaagatgtaaaaagtgggcgctatatggaattagagcaacgttacatggacctcgctgagaatgcccgttttgaacgggagcagcttcttggtgtccagcagcatttaagcaatactttgaaaatggcagaacaagacaataaggaagctcaagaaatgataggggcactcaaagaacgcagtcaccatatggagcgaattattgagtctgagcagaaaggaaaagcagccttggcagccacgttagaggaatacaaagccacagtggccagtgaccagatagagatgaatcgcctgaaggctcagctggagaatgaaaagcagaaagtggcagagctgtattctatccataactctggagacaaatctgatattcaggacctcctggagagtgtcaggctggacaaagaaaaagcagagactttggctagtagcttgcaggaagatctggctcatacccgaaatgatgccaatcgattacaggatgccattgctaaggtagaggatgaataccgagccttccaagaagaagctaagaaacaaattgaagatttgaatatgacgttagaaaaattaagatcagacctggatgaaaaagaaacagaaaggagtgacatgaaagaaaccatctttgaacttgaagatgaagtagaacaacatcgtgctgtgaaacttcatgacaacctcattatttctgatctagagaatacagttaaaaaactccaggaccaaaagcacgacatggaaagagaaataaagacactccacagaagacttcgggaagaatctgcggaatggcggcagtttcaggctgatctccagactgcagtagtcattgcaaatgacattaaatctgaagcccaagaggagattggtgatctaaagcgccggttacatgaggctcaagaaaaaaatgagaaactcacaaaagaattggaggaaataaagtcacgcaagcaagaggaggagcgaggccgggtatacaattacatgaatgccgttgagagagatttggcagccttaaggcagggaatgggactgagtagaaggtcctcgacttcctcagagccaactcctacagtaaaaaccctcatcaagtcctttgacagtgcatctcaagtaccaaaccctgctgcagctgcaattcctcgaacgcccctgagcccaagtcctatgaaaacccctcctgcagcagctgtgtcccctatgcagagacattccataagtggaccaatctcaacatccaaacccctgacagccctgtcagataagagaccaaactatggggaaatccctgttcaagagcatctgttaagaacatcttcagccagccggcctgcttccctgccaagagtgcctgcgatggaaagtgccaagaccctctcagtgtctcgacgaagtagtgaagaagtgaaacgggacatttctgcacaggagggagcgtcgccagcctctctgatggctatgggaaccacgtctccacagctttccctgtcctcttctccaacggcatctgtgactcccaccacccgaagccgaataagagaagaaaggaaagaccctctctcagcattggccagagaatatggaggatcaaagaggaacgccttgctgaagtggtgtcagaagaaaacagaaggctatcagaatattgacattacaaacttcagcagcagctggaatgatgggctggccttctgtgccctcctgcatacatatctccctgcccacattccatatcaagaactgaacagccaggataagagaaggaacttcatgctggctttccaggcagctgaaagtgtcggcatcaaatccacactggacattaatgaaatggtacggactgaacgacccgactggcagaacgtgatgctgtatgtgacggcgatctacaagtactttgagacctgagcatgccgggaggagccgccccaatagcgggggtacccctccacagcgaccgagcgacaccgacgccattagctacgcacccctgtaaagcttccagcaactctgggctgccccacagcgtgtgagcctccagctcggggcttccgtattggaagaactcagccgtgtggcccacagctcccaccagggcccctcccacatgacccgtccattcaggtcatgtgggctcagcacacatcctgcaggccggtggctgctggagttttccttctgaagagaatattgaactacactagtgctccagggcaccaaacaaaaagggctcatgcacagctgaatttgggaaaagggattcagttctgtgggaaactcactagggttgatgaaggctcggccgcggcacttcctgactattggctggggtgggttccggtgctggtgagaacccagaaggagagtcagcgcctggcagttcccagcgccctgggcccttcaccgtcctagtttggaggagcatgttcaccacagacgtgggtcagctgccccacacctgacggggctgtcccggccgacacaatccaggcgtgttcagcctgagctaggagagtatctagagggcgtggtgcgggcacgccagggctggggtgctgctgctgcactcacgcggctgggctttctggcgggaagcagttacgggggccccttgcctggactcagcgacctgtcttccagcctggaaggggtttggagtcccagctctggctttagatttcttcatcataaggagtttttctagttaacatttttgttttgttacgagcaatgctggaaaaggtcgctcctgttctgttagtaccaaagttacattgtttcaataagcatagaaatctaaacaacatctgtacattagcatggtgagagcaaggaataaagcaggaaataggagaaaagtaaacaactttagggagcccaggcagtgtcatttaaactcactgagtcactaagacataattctcctaggccagagttaaagaaagtgccttaactcttcttgtgagggcagccactgccctccgtggccaaggcaggacctccaagactcagtggttgagttgtctcctaccaccatgcccgccctccccaggtactgggtccatgccccctgtgcccaccctccccaggtgctgggtccatgctgtttgaaccaaagccttatttaaaggtggtcactggagatgctctcaggccagaactcaacagctatttttgggaatagggatctcccgtgtgcctaacgcagtagctattggtttgaacaatgtccagacaagacctgtacctttgagaatataactgtgtttggcacctgcatagcaccatgaggaagaccagccaccagtggaagcggggtcactgccccacagactggatgcaatgaggggctcacaggaggcccagccagcccgattgtgggctgaggggtctgcattcaagcacgatgttctagaataggagtttaacgtgtctacgtaacctagaatgtggttattaggaaaggggctgtgcatgtgggtgcagctggcggcacacctggtcaccagatggccagaagctgcccatcagccctgcccagatgtcagcctgggagctcaggctgctgccgctggctggatgccctttggtgaaatgcctgttttcagctaagaaaggagaggccaggcaagcaaagtcatgccacaaagcatatcagagacccccgcagactcctggccccgtcccgccccctgtctgagttgtgtttttgttgctgttcctctgttgatggccagctctgctgttggcatgagccactgatgttcatgtgagaattactgtttttaagtgtctctccacttaggtgtcctcagttcccacttttgctctcatttgccttcacagaggccactccacctgtccggatccagctgtctggtcatggtttggtttatttattttgtccttcaggggctgttttgccctaagaatgagggggcttcccctggtctgcagttcccaactttatcccttgctggccatgcgagcccagccctggtgcctcatgggatgggggggtaggggtccccaggatcttctggaggaaggtggccatggatggatgggctgtatctgtgttttccctctgggagtctcatgggtccagcatcaggcctgaggtcagcaacagggaaagagggtgggcacggggagggcttggccccgcctatctagaggcttgcctcgggcccctccttggggaaggtttgcgtgcagagctgcaagggagagggttccagaagcattgccttttgcctcgtctaataggatccttaggacactgtgggctttaggaatgactatagatgctcacacgtgtttaaagtgacatttggagatgctctcagtcctgtggcatctggcacgaagtctccaagaagccactttgcctcttctcccttcaagcacaagctttactgcaaaagggccagtcgcgtttctatttctctcgatcccaggcttctgcggaccgacgatacgtttaaatgttgttctagtaaatattcttgaatgtattaaaatggctgaaacaacaagcttgggcttttctagcttgccctccactccctgccgtccctctgacgtcgcataaaccagaacccagctccctcctgggactggctgtggagagaagggcacctctgagccagcctgtggccctaccccaaggcgcacttcctcatgtgggcagatcctgaccaggagtccagggtggcctcccctgggccacagcacatcaccgtgtggcctggggctgtgggacagtgagccctgtaaccactagggttctgtgacagatgccaagaccccagagaccgtggcagagctacccccaggagagcggaagcccctacacagcccagacacatgccttccctgggggctggggagtgtgtctcgaggggttttgtttgttttgaggcatgtatcatcttggaaataattgtcaggatgtataaaatagagaaaaagaaaaaaggtatcctacccagaggcaaccagataaacttttttgcctgtgca

SEQ ID NO: 185467 - DNA, 6674 bp, Homo sapiens
  Payload ID: 16525
  Gene Symbol: SPECC1L
  Gene Name: sperm antigen with calponin homology and coiled-coil domains 1-like
  Uniprot ID: Q69YQ0
  ENST ID: ENST00000437398
  CDS Start-End: 205-3558
tggccaagggcggggcccgcgagggaggccgggcggcccggcaagcggcgctgcggggtaggctgctttcctgaggccggactcaacgggtctcggctgagccaccgggtgagctcaccgcccagcccaaaccaggagattgcgagggagcgatgcggtgcagcgcgatttgcttgtaaatgcatcacgaagaggcagcccagaatgaagaaagcaagcaggagtgttggctcagtgcctaaagtgtctgcaataagtaaaacgcaaacagcagaaaaaattaaacctgaaaacagctcttcagcatctacgggaggcaaacttgtaaaacctggaacagcagcatcattgtcaaagaccaagagcagtgatgaccttttagctggaatggccggaggggtaacggtgactaatggtgttaaaggaaagaaaagcacctgcccatctgcagcaccttcagcatctgcccctgccatgaccaccgtggagaacaaatccaagattagcacaggcacagcttcttcaaccaagcggagcacttctacaggtaataaagaatccagttctactagagaaagattacgtgaacgtacccgattaaaccagagcaaaaaactaccttctgcaggtcagggagctaatgacatggcattggccaaacgttcccgcagtcgaactgctacagaatgtgacgttcgtatgagcaagtctaagtcagacaatcagatcagtgacagagctgctttggaggccaaagtgaaggatcttctcacgctggcaaaaaccaaagacgtagaaattttacatttgagaaatgaactgcgagacatgcgtgcccagctgggcattaatgaggatcattctgagggtgatgaaaaatctgagaaggaaactattatggctcaccagccgactgatgtggagtccactttattgcagttgcaggaacagaatactgccatccgtgaagaactcaaccagctgaaaaatgaaaacagaatgttaaaggacaggttgaatgcattgggcttttccctagagcagaggttagacaattctgaaaaactgtttggctatcagtccctgagcccagaaatcacccctggtaaccagagcgatggaggaggaactctgacttcttcagtggaaggctctgcccctggctcagtggaggatctcttgagtcaggatgaaaatacactaatggaccatcagcacagtaactccatggacaatttagacagtgagtgcagtgaggtctaccagcccctcacatcgagcgatgatgcgctggatgcaccatcctcctcagagtcggaaggcatccccagcatagagcgctcccggaaggggagcagcgggaatgccagtgaagtgtccgtggcttgcctgactgaacggatacaccagatggaagagaaccaacacagtacaagtgaggaactccaggcaaccctgcaagagctagctgatttacagcagattacccaggaactgaatagtgaaaacgaaaggcttggagaagagaaggttattctgatggagtctttatgtcagcagagcgataagttggaacactttagtcgacagattgaatacttccgctctcttctagatgagcatcacatttcttatgtcatagatgaagatgtaaaaagtgggcgctatatggaattagagcaacgttacatggacctcgctgagaatgcccgttttgaacgggagcagcttcttggtgtccagcagcatttaagcaatactttgaaaatggcagaacaagacaataaggaagctcaagaaatgataggggcactcaaagaacgcagtcaccatatggagcgaattattgagtctgagcagaaaggaaaagcagccttggcagccacgttagaggaatacaaagccacagtggccagtgaccagatagagatgaatcgcctgaaggctcagctggagaatgaaaagcagaaagtggcagagctgtattctatccataactctggagacaaatctgatattcaggacctcctggagagtgtcaggctggacaaagaaaaagcagagactttggctagtagcttgcaggaagatctggctcatacccgaaatgatgccaatcgattacaggatgccattgctaaggtagaggatgaataccgagccttccaagaagaagctaagaaacaaattgaagatttgaatatgacgttagaaaaattaagatcagacctggatgaaaaagaaacagaaaggagtgacatgaaagaaaccatctttgaacttgaagatgaagtagaacaacatcgtgctgtgaaacttcatgacaacctcattatttctgatctagagaatacagttaaaaaactccaggaccaaaagcacgacatggaaagagaaataaagacactccacagaagacttcgggaagaatctgcggaatggcggcagtttcaggctgatctccagactgcagtagtcattgcaaatgacattaaatctgaagcccaagaggagattggtgatctaaagcgccggttacatgaggctcaagaaaaaaatgagaaactcacaaaagaattggaggaaataaagtcacgcaagcaagaggaggagcgaggccgggtatacaattacatgaatgccgttgagagagatttggcagccttaaggcagggaatgggactgagtagaaggtcctcgacttcctcagagccaactcctacagtaaaaaccctcatcaagtcctttgacagtgcatctcaagtaccaaaccctgctgcagctgcaattcctcgaacgcccctgagcccaagtcctatgaaaacccctcctgcagcagctgtgtcccctatgcagagacattccataagtggaccaatctcaacatccaaacccctgacagccctgtcagataagagaccaaactatggggaaatccctgttcaagagcatctgttaagaacatcttcagccagccggcctgcttccctgccaagagtgcctgcgatggaaagtgccaagaccctctcagtgtctcgacgaagtagtgaagaagtgaaacgggacatttctgcacaggagggagcgtcgccagcctctctgatggctatgggaaccacgtctccacagctttccctgtcctcttctccaacggcatctgtgactcccaccacccgaagccgaataagagaagaaaggaaagaccctctctcagcattggccagagaatatggaggatcaaagaggaacgccttgctgaagtggtgtcagaagaaaacagaaggctatcagaatattgacattacaaacttcagcagcagctggaatgatgggctggccttctgtgccctcctgcatacatatctccctgcccacattccatatcaagaactgaacagccaggataagagaaggaacttcatgctggctttccaggcagctgaaagtgtcggcatcaaatccacactggacattaatgaaatggtacggactgaacgacccgactggcagaacgtgatgctgtatgtgacggcgatctacaagtactttgagacctgagcatgccgggaggagccgccccaatagcgggggtacccctccacagcgaccgagcgacaccgacgccattagctacgcacccctgtaaagcttccagcaactctgggctgccccacagcgtgtgagcctccagctcggggcttccgtattggaagaactcagccgtgtggcccacagctcccaccagggcccctcccacatgacccgtccattcaggtcatgtgggctcagcacacatcctgcaggccggtggctgctggagttttccttctgaagagaatattgaactacactagtgctccagggcaccaaacaaaaagggctcatgcacagctgaatttgggaaaagggattcagttctgtgggaaactcactagggttgatgaaggctcggccgcggcacttcctgactattggctggggtgggttccggtgctggtgagaacccagaaggagagtcagcgcctggcagttcccagcgccctgggcccttcaccgtcctagtttggaggagcatgttcaccacagacgtgggtcagctgccccacacctgacggggctgtcccggccgacacaatccaggcgtgttcagcctgagctaggagagtatctagagggcgtggtgcgggcacgccagggctggggtgctgctgctgcactcacgcggctgggctttctggcgggaagcagttacgggggccccttgcctggactcagcgacctgtcttccagcctggaaggggtttggagtcccagctctggctttagatttcttcatcataaggagtttttctagttaacatttttgttttgttacgagcaatgctggaaaaggtcgctcctgttctgttagtaccaaagttacattgtttcaataagcatagaaatctaaacaacatctgtacattagcatggtgagagcaaggaataaagcaggaaataggagaaaagtaaacaactttagggagcccaggcagtgtcatttaaactcactgagtcactaagacataattctcctaggccagagttaaagaaagtgccttaactcttcttgtgagggcagccactgccctccgtggccaaggcaggacctccaagactcagtggttgagttgtctcctaccaccatgcccgccctccccaggtactgggtccatgccccctgtgcccaccctccccaggtgctgggtccatgctgtttgaaccaaagccttatttaaaggtggtcactggagatgctctcaggccagaactcaacagctatttttgggaatagggatctcccgtgtgcctaacgcagtagctattggtttgaacaatgtccagacaagacctgtacctttgagaatataactgtgtttggcacctgcatagcaccatgaggaagaccagccaccagtggaagcggggtcactgccccacagactggatgcaatgaggggctcacaggaggcccagccagcccgattgtgggctgaggggtctgcattcaagcacgatgttctagaataggagtttaacgtgtctacgtaacctagaatgtggttattaggaaaggggctgtgcatgtgggtgcagctggcggcacacctggtcaccagatggccagaagctgcccatcagccctgcccagatgtcagcctgggagctcaggctgctgccgctggctggatgccctttggtgaaatgcctgttttcagctaagaaaggagaggccaggcaagcaaagtcatgccacaaagcatatcagagacccccgcagactcctggccccgtcccgccccctgtctgagttgtgtttttgttgctgttcctctgttgatggccagctctgctgttggcatgagccactgatgttcatgtgagaattactgtttttaagtgtctctccacttaggtgtcctcagttcccacttttgctctcatttgccttcacagaggccactccacctgtccggatccagctgtctggtcatggtttggtttatttattttgtccttcaggggctgttttgccctaagaatgagggggcttcccctggtctgcagttcccaactttatcccttgctggccatgcgagcccagccctggtgcctcatgggatgggggggtaggggtccccaggatcttctggaggaaggtggccatggatggatgggctgtatctgtgttttccctctgggagtctcatgggtccagcatcaggcctgaggtcagcaacagggaaagagggtgggcacggggagggcttggccccgcctatctagaggcttgcctcgggcccctccttggggaaggtttgcgtgcagagctgcaagggagagggttccagaagcattgccttttgcctcgtctaataggatccttaggacactgtgggctttaggaatgactatagatgctcacacgtgtttaaagtgacatttggagatgctctcagtcctgtggcatctggcacgaagtctccaagaagccactttgcctcttctcccttcaagcacaagctttactgcaaaagggccagtcgcgtttctatttctctcgatcccaggcttctgcggaccgacgatacgtttaaatgttgttctagtaaatattcttgaatgtattaaaatggctgaaacaacaagcttgggcttttctagcttgccctccactccctgccgtccctctgacgtcgcataaaccagaacccagctccctcctgggactggctgtggagagaagggcacctctgagccagcctgtggccctaccccaaggcgcacttcctcatgtgggcagatcctgaccaggagtccagggtggcctcccctgggccacagcacatcaccgtgtggcctggggctgtgggacagtgagccctgtaaccactagggttctgtgacagatgccaagaccccagagaccgtggcagagctacccccaggagagcggaagcccctacacagcccagacacatgccttccctgggggctggggagtgtgtctcgaggggttttgtttgttttgaggcatgtatcatcttggaaataattgtcaggatgtataaaatagagaaaaagaaaaaaggtatcctacccagaggcaaccagataaacttttttgcctgtgc

SEQ ID NO: 185468 - DNA, 2565 bp, Homo sapiens
  Payload ID: 16525
  Gene Symbol: SPECC1L
  Gene Name: sperm antigen with calponin homology and coiled-coil domains 1-like
  ENST ID: ENST00000421374
  CDS Start-End: 200-2565
aagggcggggcccgcgagggaggccgggcggcccggcaagcggcgctgcggggtaggctgctttcctgaggccggactcaacgggtctcggctgagccaccgggtgagctcaccgcccagcccaaaccaggagattgcgagggagcgatgcggtgcagcgcgatttgcttgtaaatgcatcacgaagaggcagcccagaatgaagaaagcaagcaggagtgttggctcagtgcctaaagtgtctgcaataagtaaaacgcaaacagcagaaaaaattaaacctgaaaacagctcttcagcatctacgggaggcaaacttgtaaaacctggaacagcagcatcattgtcaaagaccaagagcagtgatgaccttttagctggaatggccggaggggtaacggtgactaatggtgttaaaggaaagaaaagcacctgcccatctgcagcaccttcagcatctgcccctgccatgaccaccgtggagaacaaatccaagattagcacaggcacagcttcttcaaccaagcggagcacttctacaggtaataaagaatccagttctactagagaaagattacgtgaacgtacccgattaaaccagagcaaaaaactaccttctgcaggtcagggagctaatgacatggcattggccaaacgttcccgcagtcgaactgctacagaatgtgacgttcgtatgagcaagtctaagtcagacaatcagatcagtgacagagctgctttggaggccaaagtgaaggatcttctcacgctggcaaaaaccaaagacgtagaaattttacatttgagaaatgaactgcgagacatgcgtgcccagctgggcattaatgaggatcattctgagggtgatgaaaaatctgagaaggaaactattatggctcaccagccgactgatgtggagtccactttattgcagttgcaggaacagaatactgccatccgtgaagaactcaaccagctgaaaaatgaaaacagaatgttaaaggacaggttgaatgcattgggcttttccctagagcagaggttagacaattctgaaaaactgtttggctatcagtccctgagcccagaaatcacccctggtaaccagagcgatggaggaggaactctgacttcttcagtggaaggctctgcccctggctcagtggaggatctcttgagtcaggatgaaaatacactaatggaccatcagcacagtaactccatggacaatttagacagtgagtgcagtgaggtctaccagcccctcacatcgagcgatgatgcgctggatgcaccatcctcctcagagtcggaaggcatccccagcatagagcgctcccggaaggggagcagcgggaatgccagtgaagtgtccgtggcttgcctgactgaacggatacaccagatggaagagaaccaacacagtacaagtgaggaactccaggcaaccctgcaagagctagctgatttacagcagattacccaggaactgaatagtgaaaacgaaaggcttggagaagagaaggttattctgatggagtctttatgtcagcagagcgataagttggaacactttagtcgacagattgaatacttccgctctcttctagatgagcatcacatttcttatgtcatagatgaagatgtaaaaagtgggcgctatatggaattagagcaacgttacatggacctcgctgagaatgcccgttttgaacgggagcagcttcttggtgtccagcagcatttaagcaatactttgaaaatggcagaacaagacaataaggaagctcaagaaatgataggggcactcaaagaacgcagtcaccatatggagcgaattattgagtctgagcagaaaggaaaagcagccttggcagccacgttagaggaatacaaagccacagtggccagtgaccagatagagatgaatcgcctgaaggctcagctggagaatgaaaagcagaaagtggcagagctgtattctatccataactctggagacaaatctgatattcaggacctcctggagagtgtcaggctggacaaagaaaaagcagagactttggctagtagcttgcaggaagatctggctcatacccgaaatgatgccaatcgattacaggatgccattgctaaggtagaggatgaataccgagccttccaagaagaagctaagaaacaaattgaagatttgaatatgacgttagaaaaattaagatcagacctggatgaaaaagaaacagaaaggagtgacatgaaagaaaccatctttgaacttgaagatgaagtagaacaacatcgtgctgtgaaacttcatgacaacctcattatttctgatctagagaatacagttaaaaaactccaggaccaaaagcacgacatggaaagagaaataaagacactccacagaagacttcgggaagaatctgcggaatggcggcagtttcaggctgatctccagactgcagtagtcattgcaaatgacattaaatctgaagcccaagaggagattggtgatctaaagcgccggttacatgaggctcaagaaaaaaatgagaaactcac

SEQ ID NO: 185469 - DNA, 612 bp, Homo sapiens
  Payload ID: 16525
  Gene Symbol: SPECC1L
  Gene Name: sperm antigen with calponin homology and coiled-coil domains 1-like
  ENST ID: ENST00000440893
  CDS Start-End: 88-612
ggacacttcactgctggttggagcttttgtaaatacaaaacactactgctgctcacaaccaagagcagtgatgaccttttagctggaatggccggaggggtaacggtgactaatggtgttaaaggaaagaaaagcacctgcccatctgcagcaccttcagcatctgcccctgccatgaccaccgtggagaacaaatccaagattagcacaggcacagcttcttcaaccaagcggagcacttctacaggtaataaagaatccagttctactagagaaagattacgtgaacgtacccgattaaaccagagcaaaaaactaccttctgcaggtcagggagctaatgacatggcattggccaaacgttcccgcagtcgaactgctacagaatgtgacgttcgtatgagcaagtctaagtcagacaatcagatcagtgacagagctgctttggaggccaaagtgaaggatcttctcacgctggcaaaaaccaaagacgtagaaattttacatttgagaaatgaactgcgagacatgcgtgcccagctgggcattaatgaggatcattctgagggtgatgaaaaatctgagaaggaaactattatggctcaccagccg

SEQ ID NO: 185470 - DNA, 3525 bp, Homo sapiens
  Payload ID: 16525
  Gene Symbol: SPECC1L
  Gene Name: sperm antigen with calponin homology and coiled-coil domains 1-like
  Uniprot ID: Q69YQ0
  ENST ID: ENST00000541492
  CDS Start-End: 139-3375
tttcctgaggccggactcaacgggtctcggctgagccaccgggtgagctcaccgcccagcccaaaccaggagattgcgagggagcgatgcggtgcagcgcgatttgcttgtaaatgcatcacgaagaggcagcccagaatgaagaaagcaagcaggagtgttggctcagtgcctaaagtgtctgcaataagtaaaacgcaaacagcagaaaaaattaaacctgaaaacagctcttcagcatctacgggaggcaaacttgtaaaacctggaacagcagcatcattgtcaaagaccaagagcagtgatgaccttttagctggaatggccggaggggtaacggtgactaatggtgttaaaggaaagaaaagcacctgcccatctgcagcaccttcagcatctgcccctgccatgaccaccgtggagaacaaatccaagattagcacaggcacagcttcttcaaccaagcggagcacttctacaggtaataaagaatccagttctactagagaaagattacgtgaacgtacccgattaaaccagagcaaaaaactaccttctgcaggtcagggagctaatgacatggcattggccaaacgttcccgcagtcgaactgctacagaatgtgacgttcgtatgagcaagtctaagtcagacaatcagatcagtgacagagctgctttggaggccaaagtgaaggatcttctcacgctggcaaaaaccaaagacgtagaaattttacatttgagaaatgaactgcgagacatgcgtgcccagctgggcattaatgaggatcattctgagggtgatgaaaaatctgagaaggaaactattatggctcaccagccgactgatgtggagtccactttattgcagttgcaggaacagaatactgccatccgtgaagaactcaaccagctgaaaaatgaaaacagaatgttaaaggacaggttgaatgcattgggcttttccctagagcagaggttagacaattctgaaaaactgtttggctatcagtccctgagcccagaaatcacccctggtaaccagagcgatggaggaggaactctgacttcttcagtggaaggctctgcccctggctcagtggaggatctcttgagtcaggatgaaaatacactaatggaccatcagcacagtaactccatggacaatttagacagtgagtgcagtgaggtctaccagcccctcacatcgagcgatgatgcgctggatgcaccatcctcctcagagtcggaaggcatccccagcatagagcgctcccggaaggggagcagcgggaatgccagtgaagtgtccgtggcttgcctgactgaacggatacaccagatggaagagaaccaacacagtacaagtgaggaactccaggcaaccctgcaagagctagctgatttacagcagattacccaggaactgaatagtgaaaacgaaaggcttggagaagagaaggttattctgatggagtctttatgtcagcagagcgataagttggaacactttagtcgacagattgaatacttccgctctcttctagatgagcatcacatttcttatgtcatagatgaagatgtaaaaagtgggcgctatatggaattagagcaacgttacatggacctcgctgagaatgcccgttttgaacgggagcagcttcttggtgtccagcagcatttaagcaatactttgaaaatggcagaacaagacaataaggaagctcaagaaatgataggggcactcaaagaacgcagtcaccatatggagcgaattattgagtctgagcagaaaggaaaagcagccttggcagccacgttagaggaatacaaagccacagtggccagtgaccagatagagatgaatcgcctgaaggctcagctggagaatgaaaagcagaaagtggcagagctgtattctatccataactctggagacaaatctgatattcaggacctcctggagagtgtcaggctggacaaagaaaaagcagagactttggctagtagcttgcaggaagatctggctcatacccgaaatgatgccaatcgattacaggatgccattgctaaggtagaggatgaataccgagccttccaagaagaagctaagaaacaaattgaagatttgaatatgacgttagaaaaattaagatcagacctggatgaaaaagaaacagaaaggagtgacatgaaagaaaccatctttgaacttgaagatgaagtagaacaacatcgtgctgtgaaacttcatgacaacctcattatttctgatctagagaatacagttaaaaaactccaggaccaaaagcacgacatggaaagagaaataaagacactccacagaagacttcgggaagaatctgcggaatggcggcagtttcaggctgatctccagactgcagtagtcattgcaaatgacattaaatctgaagcccaagaggagattggtgatctaaagcgccggttacatgaggctcaagaaaaaaatgagaaactcacaaaagaattggaggaaataaagtcacgcaagcaagaggaggagcgaggccgggtatacaattacatgaatgccgttgagagagatttggcagccttaaggcagggaatgggactgagtagaaggtcctcgacttcctcagagccaactcctacagtaaaaaccctcatcaagtcctttgacagtgcatctcaagtaccaaaccctgctgcagctgcaattcctcgaacgcccctgagcccaagtcctatgaaaacccctcctgcagcagctgtgtcccctatgcagagacattccataagtggaccaatctcaacatccaaacccctgacagccctgtcagataagagaccaaactatggggaaatccctgttcaagagcatctgttaagaacatcttcagccagccggcctgcttccctgccaagagtgcctgcgatggaaagtgccaagaccctctcagtgtctcgacgaagtagtgaagaagtgaaacgggacatttctgcacaggagggagcgtcgccagcctctctgatggctatgggaaccacgtctccacagctttccctgtcctcttctccaacggcatctgtgactcccaccacccgaagccgaataagagaagaaaggaaagaccctctctcagcattggccagagaatatggaggatcaaagaggaacgccttgctgaagtggtgtcagaagaaaacagaaggctatcagagaaggaacttcatgctggctttccaggcagctgaaagtgtcggcatcaaatccacactggacattaatgaaatggtacggactgaacgacccgactggcagaacgtgatgctgtatgtgacggcgatctacaagtactttgagacctgagcatgccgggaggagccgccccaatagcgggggtacccctccacagcgaccgagcgacaccgacgccattagctacgcacccctgtaaagcttccagcaactctgggctgccccacagcgtgtgagcctccagctcggggcttccgtatt

SEQ ID NO: 185471 - DNA, 3748 bp, Homo sapiens
  Payload ID: 16526
  Gene Symbol: SPAG1
  Gene Name: sperm associated antigen 1
  Uniprot ID: Q07617
  ENST ID: ENST00000251809
  CDS Start-End: 87-2867
gacgagaccctccctcagcacctgcagtgcagccagagccggtgcggcggccgcgacttccccgacgcggggcgctgagaagcactatgaccaccaaagattatccatcattgtggggctttggaacaacaaaaacattcaaaattcccattgaacatctagatttcaaatacattgaaaaatgttcagatgttaaacatctggaaaaaattctttgcgtgctcagatctggtgaggaaggatattatcctgaacttacagaattttgtgaaaagcatcttcaagccttggcccctgaaagcagagctttgaggaaagataaaccagcagcaacagcagccagttttacagctgaagaatgggaaaaaattgatggtgatataaagagttgggtatcagaaattaaaaaagaagaagataaaatgcactttcatgaaactgagacatttccagcaatgaaagataatttgcctccagttcgtggttcaaacagctgtcttcatgtaggcaaggaaaaatattctaaaagaccaactaaaaagaaaactccaagggattacgcggaatgggataaatttgacgtggagaaggaatgtttaaaaattgatgaagattacaaagaaaagacggtaatagacaagtcacacttgtctaaaattgagacaagaatagatacagcaggtctaactgagaaagaaaaggattttcttgccactcgtgaaaaggagaaaggaaatgaagctttcaactcaggagattatgaagaagcagtgatgtattataccaggagcatatcagcgcttcccactgtagttgcctataacaatcgagctcaagcagaaatcaaattacagaactggaatagtgcttttcaggattgtgaaaaggtcttggagttagaacctggaaacgtaaaggctcttctgcgtcgtgctactacatataaacatcaaaacaagctccgggaagctacagaagatttgagtaaagtactagatgttgagcctgataatgatttggccaagaaaaccttgtcagaggttgaaagagatctgaaaaattctgaagctgcatctgagactcaaaccaaagggaaaaggatggttattcaggaaatagaaaactccgaagatgaagaaggaaaaagcggaagaaaacatgaagatggcggtggagataagaagcccgcggagccggcgggagccgcgcgcgccgcccagccgtgcgtcatgggcaacatccagaagaagctgactggcaaagccgaaggcggcaagcggccggcaaggggcgcgccgcagcggggccagaccccggaggccggcgcggacaagcggagcccacggcgggcctctgcggcggcggcggcgggcggcggcgccaccgggcatccgggcggcgggcagggcgcggagaaccctgccggcctgaagagccagggcaacgagctgttccgaagcgggcagttcgccgaggcggccggcaagtactcggcggcaatcgcgctcctggagccagcaggaagtgaaattgcagatgatctaagtatcttatattcaaatagagcagcatgttacctaaaagaaggaaactgcagtggctgcattcaagattgtaacagggctctggaacttcatccattctctatgaaacctcttctgaggcgggcgatggcctatgaaactctagagcagtatgggaaagcttatgtggattataaaacagtgttgcagatagactgtggactccagctagcaaatgacagtgttaacaggctatcaagaattttaatggagctggatggaccaaattggcgggagaagctgtcacctattcctgctgtgcctgcttctgtgccactgcaagcttggcatccggcaaaagagatgatctcaaaacaagcaggagactccagcagccatcgccagcagggcatcacagatgaaaaaacatttaaagcccttaaggaagaaggaaatcaatgtgtaaatgacaaaaactataaagacgccctcagtaaatacagcgaatgcttaaagattaacaataaggaatgtgccatatatacaaacagagctctctgttacttgaagctgtgccagtttgaagaagcaaagcaggactgtgatcaggcacttcagctagctgatgggaacgtgaaagccttctatagacgagctctggctcataaaggactcaagaattatcagaaaagcttaattgatctcaataaagttatcctactagatccaagtattattgaggcaaagatggaactggaagaggtaactagactccttaatcttaaggataagacagcaccattcaacaaagaaaaggagagaaggaaaattgagattcaagaggtgaatgaaggcaaggaggagcctggaagacctgcaggggaggtctccatgggatgccttgcttctgagaagggaggcaaaagcagcaggtcaccagaagaccctgagaaacttccgatagccaagcctaataatgcctatgaatttggtcagattataaatgctctcagtaccaggaaggataaagaagcctgtgcacatcttttagccatcactgcaccaaaagatttgccgatgtttttaagtaacaaacttgaaggggatacattccttctcctcattcagtctctgaaaaataatcttattgaaaaagatccctcattggtgtatcagcatcttttatacctgagtaaagcagaaaggtttaagatgatgttgacactaattagcaagggccaaaaggagctaattgaacagctgtttgaggacctttcggacacaccaaacaaccattttactttagaagatatacaggccctaaaaaggcagtatgagctttaaatcaagataattgttagatttcttccatgcatgtatgtgttccaggaatgttaatgagatggtattgtaaaagagttgcatggataaaacttggcctagaaaagtttggtctgcactataaaacattttacttattttcctacatagaacatgtatattctacaatctgctttttattagttgtaaatattttcttatgtaccagaaccaaataagtatatttagaacttgttaaaaatacattttaatttatgatatacatattattttaattacttgttaaaattttgagttaagttgcatttctttgggctatgaaggagtcctcttaagtttgatagaaatgaatttcttgtaacattcttttttaaaagtggaagtcattaacagtgattattatatcacttatatcctgctaagatacacataaatcccattttgtactagtacctgtggattacagtcagttaaaatgaaatgcaacactgaagtctataacatgaaatgattattaaattgtttattaatttagagctataagaggaacttattttttctaatacggaagcattgcctaataattaagaacaaaaattgccaaaaatttctaccactttttactagattttaaaaagctactttcttttatattgcctatataagcaaaaaaccaaccactgtattaaagcaaactaagcctgcatttatatctgaattattacctccatattttaccaaacatttgaatgtcccccttcccccttttttgttttctgcttttatgactgtatttattcctttactgtaaaagaatatgaagaactcatacatgttgaaagctcctttgttgactgggtcaaagtgaaggaatttcaatctcc

SEQ ID NO: 185472 - DNA, 3852 bp, Homo sapiens
  Payload ID: 16526
  Gene Symbol: SPAG1
  Gene Name: sperm associated antigen 1
  Uniprot ID: Q07617
  ENST ID: ENST00000388798
  CDS Start-End: 192-2972
ggggctccccagtcccggcaggtcctggcgccgctgtacatagaaaccgttgccacggcgggaggatgccgtttcttttcggtctccgactgcagggggcggtcggccctgtggatgcaggaaagagggtgcctcggtgggagagacccagcttttcgcgttagtaggcccgagcagtttgaactggagctatgaccaccaaagattatccatcattgtggggctttggaacaacaaaaacattcaaaattcccattgaacatctagatttcaaatacattgaaaaatgttcagatgttaaacatctggaaaaaattctttgcgtgctcagatctggtgaggaaggatattatcctgaacttacagaattttgtgaaaagcatcttcaagccttggcccctgaaagcagagctttgaggaaagataaaccagcagcaacagcagccagttttacagctgaagaatgggaaaaaattgatggtgatataaagagttgggtatcagaaattaaaaaagaagaagataaaatgcactttcatgaaactgagacatttccagcaatgaaagataatttgcctccagttcgtggttcaaacagctgtcttcatgtaggcaaggaaaaatattctaaaagaccaactaaaaagaaaactccaagggattacgcggaatgggataaatttgacgtggagaaggaatgtttaaaaattgatgaagattacaaagaaaagacggtaatagacaagtcacacttgtctaaaattgagacaagaatagatacagcaggtctaactgagaaagaaaaggattttcttgccactcgtgaaaaggagaaaggaaatgaagctttcaactcaggagattatgaagaagcagtgatgtattataccaggagcatatcagcgcttcccactgtagttgcctataacaatcgagctcaagcagaaatcaaattacagaactggaatagtgcttttcaggattgtgaaaaggtcttggagttagaacctggaaacgtaaaggctcttctgcgtcgtgctactacatataaacatcaaaacaagctccgggaagctacagaagatttgagtaaagtactagatgttgagcctgataatgatttggccaagaaaaccttgtcagaggttgaaagagatctgaaaaattctgaagctgcatctgagactcaaaccaaagggaaaaggatggttattcaggaaatagaaaactccgaagatgaagaaggaaaaagcggaagaaaacatgaagatggcggtggagataagaagcccgcggagccggcgggagccgcgcgcgccgcccagccgtgcgtcatgggcaacatccagaagaagctgactggcaaagccgaaggcggcaagcggccggcaaggggcgcgccgcagcggggccagaccccggaggccggcgcggacaagcggagcccacggcgggcctctgcggcggcggcggcgggcggcggcgccaccgggcatccgggcggcgggcagggcgcggagaaccctgccggcctgaagagccagggcaacgagctgttccgaagcgggcagttcgccgaggcggccggcaagtactcggcggcaatcgcgctcctggagccagcaggaagtgaaattgcagatgatctaagtatcttatattcaaatagagcagcatgttacctaaaagaaggaaactgcagtggctgcattcaagattgtaacagggctctggaacttcatccattctctatgaaacctcttctgaggcgggcgatggcctatgaaactctagagcagtatgggaaagcttatgtggattataaaacagtgttgcagatagactgtggactccagctagcaaatgacagtgttaacaggctatcaagaattttaatggagctggatggaccaaattggcgggagaagctgtcacctattcctgctgtgcctgcttctgtgccactgcaagcttggcatccggcaaaagagatgatctcaaaacaagcaggagactccagcagccatcgccagcagggcatcacagatgaaaaaacatttaaagcccttaaggaagaaggaaatcaatgtgtaaatgacaaaaactataaagacgccctcagtaaatacagcgaatgcttaaagattaacaataaggaatgtgccatatatacaaacagagctctctgttacttgaagctgtgccagtttgaagaagcaaagcaggactgtgatcaggcacttcagctagctgatgggaacgtgaaagccttctatagacgagctctggctcataaaggactcaagaattatcagaaaagcttaattgatctcaataaagttatcctactagatccaagtattattgaggcaaagatggaactggaagaggtaactagactccttaatcttaaggataagacagcaccattcaacaaagaaaaggagagaaggaaaattgagattcaagaggtgaatgaaggcaaggaggagcctggaagacctgcaggggaggtctccatgggatgccttgcttctgagaagggaggcaaaagcagcaggtcaccagaagaccctgagaaacttccgatagccaagcctaataatgcctatgaatttggtcagattataaatgctctcagtaccaggaaggataaagaagcctgtgcacatcttttagccatcactgcaccaaaagatttgccgatgtttttaagtaacaaacttgaaggggatacattccttctcctcattcagtctctgaaaaataatcttattgaaaaagatccctcattggtgtatcagcatcttttatacctgagtaaagcagaaaggtttaagatgatgttgacactaattagcaagggccaaaaggagctaattgaacagctgtttgaggacctttcggacacaccaaacaaccattttactttagaagatatacaggccctaaaaaggcagtatgagctttaaatcaagataattgttagatttcttccatgcatgtatgtgttccaggaatgttaatgagatggtattgtaaaagagttgcatggataaaacttggcctagaaaagtttggtctgcactataaaacattttacttattttcctacatagaacatgtatattctacaatctgctttttattagttgtaaatattttcttatgtaccagaaccaaataagtatatttagaacttgttaaaaatacattttaatttatgatatacatattattttaattacttgttaaaattttgagttaagttgcatttctttgggctatgaaggagtcctcttaagtttgatagaaatgaatttcttgtaacattcttttttaaaagtggaagtcattaacagtgattattatatcacttatatcctgctaagatacacataaatcccattttgtactagtacctgtggattacagtcagttaaaatgaaatgcaacactgaagtctataacatgaaatgattattaaattgtttattaatttagagctataagaggaacttattttttctaatacggaagcattgcctaataattaagaacaaaaattgccaaaaatttctaccactttttactagattttaaaaagctactttcttttatattgcctatataagcaaaaaaccaaccactgtattaaagcaaactaagcctgcatttatatctgaattattacctccatattttaccaaacatttgaatgtcccccttcccccttttttgttttctgcttttatgactgtatttattcctttactgtaaaagaatatgaagaactcatacatgttgaaagctcctttgttgactgggtcaaagtgaaggaatttcaatctc

SEQ ID NO: 185473 - DNA, 1723 bp, Homo sapiens
  Payload ID: 16526
  Gene Symbol: SPAG1
  Gene Name: sperm associated antigen 1
  Uniprot ID: Q07617
  ENST ID: ENST00000520643
  CDS Start-End: 216-1466
gtgaaggcggggaaggtgaacctgtggccgtcggcagatctgcagatctgccggactgcgggtcggggcgtggcaggggcctagtccccgccccggccgtcagcctgtcgcctctggctcgggccgggcgacgagaccctccctcagcacctgcagtgcagccagagccggtgcggcggccgcgacttccccgacgcggggcgctgagaagcactatgaccaccaaagattatccatcattgtggggctttggaacaacaaaaacattcaaaattcccattgaacatctagatttcaaatacattgaaaaatgttcagatgttaaacatctggaaaaaattctttgcgtgctcagatctggtgaggaaggatattatcctgaacttacagaattttgtgaaaagcatcttcaagccttggcccctgaaagcagagctttgaggaaagataaaccagcagcaacagcagccagttttacagctgaagaatgggaaaaaattgatggtgatataaagagttgggtatcagaaattaaaaaagaagaagataaaatgcactttcatgaaactgagacatttccagcaatgaaagataatttgcctccagttcgtggttcaaacagctgtcttcatgtaggcaaggaaaaatattctaaaagaccaactaaaaagaaaactccaagggattacgcggaatgggataaatttgacgtggagaaggaatgtttaaaaattgatgaagattacaaagaaaagacggtaatagacaagtcacacttgtctaaaattgagacaagaatagatacagcaggtctaactgagaaagaaaaggattttcttgccactcgtgaaaaggagaaaggaaatgaagctttcaactcaggagattatgaagaagcagtgatgtattataccaggagcatatcagcgcttcccactgtagttgcctataacaatcgagctcaagcagaaatcaaattacagaactggaatagtgcttttcaggattgtgaaaaggtcttggagttagaacctggaaacgtaaaggctcttctgcgtcgtgctactacatataaacatcaaaacaagctccgggaagctacagaagatttgagtaaagtactagatgttgagcctgataatgatttggccaagaaaaccttgtcagaggttgaaagagatctgaaaaattctgaagctgcatctgagactcaaaccaaagggaaaaggatggttattcaggaaatagaaaactccgaagatgaagaaggaaaaagcggaagaaaacatgaagatggcggtggagataagagtaaaatattttttctatttaggttatgtaaaaagctgccttttaatatgatgagctggctcaatttttctattcgtacagaaattcgtaatctatcagtttttctagctttgccttgtaaattcacaagccagtttcgctcatctttttcttaatacagcttggtagaatctctcaaacccattttccttcttaacctgtcacctttttctagtgctcagtttaattcctggtcatcacctttaaatgtaaatggctgtgtttatttgacacagaccatttgccagttaactttaaatatctctctttgataattgttttgtatatatctacttgattgcaaacaaatgtgttggtttcaaaacaggtatgggtagccccatttatatgccaaaaatgaacgtattactag

SEQ ID NO: 185474 - DNA, 1796 bp, Homo sapiens
  Payload ID: 16526
  Gene Symbol: SPAG1
  Gene Name: sperm associated antigen 1
  Uniprot ID: Q07617
  ENST ID: ENST00000520508
  CDS Start-End: 285-1535
aacgctggagttcccgggtccaccggcgcggtcagccctggtgacccaagccaggggctggggagcaatctgagaccattgcggctgggctgtggggctccccagtcccggcaggtcctggcgccgctgtacatagaaaccgttgccacggcgggaggatgccgtttcttttcggtctccgactgcagggggcggtcggccctgtggatgcaggaaagagggtgcctcggtgggagagacccagcttttcgcgttagtaggcccgagcagtttgaactggagctatgaccaccaaagattatccatcattgtggggctttggaacaacaaaaacattcaaaattcccattgaacatctagatttcaaatacattgaaaaatgttcagatgttaaacatctggaaaaaattctttgcgtgctcagatctggtgaggaaggatattatcctgaacttacagaattttgtgaaaagcatcttcaagccttggcccctgaaagcagagctttgaggaaagataaaccagcagcaacagcagccagttttacagctgaagaatgggaaaaaattgatggtgatataaagagttgggtatcagaaattaaaaaagaagaagataaaatgcactttcatgaaactgagacatttccagcaatgaaagataatttgcctccagttcgtggttcaaacagctgtcttcatgtaggcaaggaaaaatattctaaaagaccaactaaaaagaaaactccaagggattacgcggaatgggataaatttgacgtggagaaggaatgtttaaaaattgatgaagattacaaagaaaagacggtaatagacaagtcacacttgtctaaaattgagacaagaatagatacagcaggtctaactgagaaagaaaaggattttcttgccactcgtgaaaaggagaaaggaaatgaagctttcaactcaggagattatgaagaagcagtgatgtattataccaggagcatatcagcgcttcccactgtagttgcctataacaatcgagctcaagcagaaatcaaattacagaactggaatagtgcttttcaggattgtgaaaaggtcttggagttagaacctggaaacgtaaaggctcttctgcgtcgtgctactacatataaacatcaaaacaagctccgggaagctacagaagatttgagtaaagtactagatgttgagcctgataatgatttggccaagaaaaccttgtcagaggttgaaagagatctgaaaaattctgaagctgcatctgagactcaaaccaaagggaaaaggatggttattcaggaaatagaaaactccgaagatgaagaaggaaaaagcggaagaaaacatgaagatggcggtggagataagagtaaaatattttttctatttaggttatgtaaaaagctgccttttaatatgatgagctggctcaatttttctattcgtacagaaattcgtaatctatcagtttttctagctttgccttgtaaattcacaagccagtttcgctcatctttttcttaatacagcttggtagaatctctcaaacccattttccttcttaacctgtcacctttttctagtgctcagtttaattcctggtcatcacctttaaatgtaaatggctgtgtttatttgacacagaccatttgccagttaactttaaatatctctctttgataattgttttgtatatatctacttgattgcaaacaaatgtgttggtttcaaaacaggtatgggtagccccatttatatgccaaaaatgaacgtattactagaaaa

SEQ ID NO: 185475 - DNA, 534 bp, Homo sapiens
  Payload ID: 16527
  Gene Symbol: SPAG11A
  Gene Name: sperm associated antigen 11A
  Uniprot ID: Q6PDA7
  ENST ID: ENST00000351436
  CDS Start-End: 24-272
ggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagggacaggccagcagcacagacaacgctgtggataaggagagtagagacttcctcttcctgcctcctgtcttctggagttgtgaccgcagggtggcccaggtggatcggcttcagaggccaggaggcagctctctgcagccgaagagcaggagcctcacccacggtctgtggctctgactaagcctggactgcctctcggctgtgctccgtggactggctccccagggatccatgtgagagaccggagtatgatcctcagtgcgaggacaaataaaagtagtgattatgtccacccca

SEQ ID NO: 185476 - DNA, 612 bp, Homo sapiens
  Payload ID: 16527
  Gene Symbol: SPAG11A
  Gene Name: sperm associated antigen 11A
  ENST ID: ENST00000326558
  CDS Start-End: 24-350
ggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaaggggatgttccactgggaattagaaataccatctgccgtatgcagcaagggatctgcagactttttttctgccattctgggacaggccagcagcacagacaacgctgtggataaggagagtagagacttcctcttcctgcctcctgtcttctggagttgtgaccgcagggtggcccaggtggatcggcttcagaggccaggaggcagctctctgcagccgaagagcaggagcctcacccacggtctgtggctctgactaagcctggactgcctctcggctgtgctccgtggactggctccccagggatccatgtgagagaccggagtatgatcctcagtgcgaggacaaataaaagtagtgattatgtccacccca

SEQ ID NO: 185477 - DNA, 445 bp, Homo sapiens
  Payload ID: 16527
  Gene Symbol: SPAG11A
  Gene Name: sperm associated antigen 11A
  ENST ID: ENST00000326625
  CDS Start-End: 54-296
tcatatttgtgctccttcacgggagggcagggaggttcaacggaccttaaaacatgaaggtcttttttctgtttgctgttctcttttgtttggtccaaacaaactcaggggatgttccactgggaattagaaataccatctgccgtatgcagcaagggatctgcagactttttttctgccattctggtgagaaaaagcgtgacattagctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaggtgaagagctgataaaagacatttttttaacttcctta

SEQ ID NO: 185478 - DNA, 806 bp, Homo sapiens
  Payload ID: 16527
  Gene Symbol: SPAG11A
  Gene Name: sperm associated antigen 11A
  ENST ID: ENST00000400125
  CDS Start-End: 172-513
agcagtgggatagtagcgtgtccacattgtcctttgagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagaacctgcatcagatttaaaagttgttgactgcaggagaagtgaaggcttctgccaagaatactgtaattatatggaaacacaagtaggctactgctctaaaaagaaagacgcctgctgtttacattaaaactgatgttgctgatatagaaacaaagctctgccacttacctgttctccggggccacgttgtccaatcaggtgcaggttttttgcggaagtgtctgagcagcagggagcggagatattgccacttgtgccagacagttcaaatattttattgtggcaagataaatgacaaaaatgctacctgtgatcttacagaagatgacttagcttgacatgaacagaattttcaaaatcacacaatttgtgctagtaaatgtggatatcataaacttttattagaaagaattaaaataa

SEQ ID NO: 185479 - DNA, 521 bp, Homo sapiens
  Payload ID: 16527
  Gene Symbol: SPAG11A
  Gene Name: sperm associated antigen 11A
  ENST ID: ENST00000454911
  CDS Start-End: 54-206
tcatatttgtgctccttcacgggagggcagggaggttcaacggaccttaaaacatgaaggtcttttttctgtttgctgttctcttttgtttggtccaaacaaactcagtgcacatctctcaccaggaggctcgaggaccctcatttaagatctgcgtgggctttttagggcctagatgggccaggggatgttccactgggaattagaaataccatctgccgtatgcagcaagggatctgcagactttttttctgccattctggtgagaaaaagcgtgacattagctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaggtgaagagctgataaaagacatttttttaacttcctta

SEQ ID NO: 185480 - DNA, 777 bp, Homo sapiens
  Payload ID: 16527
  Gene Symbol: SPAG11A
  Gene Name: sperm associated antigen 11A
  ENST ID: ENST00000434307
  CDS Start-End: 168-479
gtgggatagtagcgtgtccacattgtcctttgagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagtgcacatctctcaccaggaggctcgaggaccctcatttaagatctgcgtgggctttttagggcctagatgggccaggggatgttccactgggaattagaaataccatctgccgtatgcagcaagggatctgcagactttttttctgccattctggtgagaaaaagcgtgacattagctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaggtgaagagctgataaaagaca

SEQ ID NO: 185481 - DNA, 552 bp, Homo sapiens
  Payload ID: 16527
  Gene Symbol: SPAG11A
  Gene Name: sperm associated antigen 11A
  ENST ID: ENST00000525884
  CDS Start-End: 1-162
tcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagaaatgaaatgaaggaggtgggctcgatctcagactccatcagagcacagcagcctgggggtgtggaagcagagcctcacccaaggaccaaggggtctccaccagggacaggccagcagcacagacaacgctgtggataaggagagtagagacttcctcttcctgcctcctgtcttctggagttgtgaccgcagggtggcccaggtggatcggcttcagaggccaggaggcagctctctgcagccgaagagcaggagcctcacccacggtctgtggctctgactaagcctggactgcctctcggctgtgctccgtggactggctccccagggatccatgtgagagaccggagtatgatcctcagtgcgaggacaaataaaagtagtgattatgtccacccca

SEQ ID NO: 185482 - DNA, 407 bp, Homo sapiens
  Payload ID: 16527
  Gene Symbol: SPAG11A
  Gene Name: sperm associated antigen 11A
  ENST ID: ENST00000528033
  CDS Start-End: 1-320
tgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagggactcactctgttgctcaggctggagtgcagtggcactgttaccgcttattgcagcctctacctcctgggctcaagtgctcctcccaccttagcctcccaaatacctgggaccaccggcatgcaccattgcacactgctagtttttttaggtgttgagccaccacttccagccccaagcttgcagctctgactacactttctccgggaagctgacactcaggcccgaatgtggctggctgccgc

SEQ ID NO: 185483 - DNA, 795 bp, Homo sapiens
  Payload ID: 16528
  Gene Symbol: SPAG11B
  Gene Name: sperm associated antigen 11B
  Uniprot ID: Q08648
  ENST ID: ENST00000297498
  CDS Start-End: 168-479
gtgggatagtagcgtgtccacattgtcctttgagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagtgcacatctctcaccgggaggctcgaggaccctcatttaggatctgtgtggactttttagggcctagatgggccaggggatgttccaccgggaattagaaataccatctgccatatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaggtgaagagctgataaaagacatttttttaacttccttac

SEQ ID NO: 185484 - DNA, 806 bp, Homo sapiens; identical to SEQ ID NO: 185478
  Payload ID: 16528
  Gene Symbol: SPAG11B
  Gene Name: sperm associated antigen 11B
  Uniprot ID: Q08648
  ENST ID: ENST00000317900
  CDS Start-End: 172-513

SEQ ID NO: 185485 - DNA, 612 bp, Homo sapiens
  Payload ID: 16528
  Gene Symbol: SPAG11B
  Gene Name: sperm associated antigen 11B
  ENST ID: ENST00000359758
  CDS Start-End: 24-350
ggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaaggggatgttccaccgggaattagaaataccatctgccatatgcagcaagggatctgcagactttttttctgccattctgggacaggccagcagcacagacaacgctgtggataaggagagtagagacttcctcttcctgcctcctgtcttctggagttgtgacctcagggtggcccaggtggatcggcttcagaggccaggaggcagctctctgcagccgaagagcaggagcctcacccagggtctgtggctctgactaagcctggactgcctctcggctgtgctccatggactggctccccagggatccatgtgagagaccggagtatgatcctcagtgcgaggacaaataaaagtagtgattatgtccacccca

SEQ ID NO: 185486 - DNA, 534 bp, Homo sapiens
  Payload ID: 16528
  Gene Symbol: SPAG11B
  Gene Name: sperm associated antigen 11B
  ENST ID: ENST00000361111
  CDS Start-End: 24-272
ggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagggacaggccagcagcacagacaacgctgtggataaggagagtagagacttcctcttcctgcctcctgtcttctggagttgtgacctcagggtggcccaggtggatcggcttcagaggccaggaggcagctctctgcagccgaagagcaggagcctcacccagggtctgtggctctgactaagcctggactgcctctcggctgtgctccatggactggctccccagggatccatgtgagagaccggagtatgatcctcagtgcgaggacaaataaaagtagtgattatgtccacccca

SEQ ID NO: 185487 - DNA, 655 bp, Homo sapiens
  Payload ID: 16528
  Gene Symbol: SPAG11B
  Gene Name: sperm associated antigen 11B
  ENST ID: ENST00000398462
  CDS Start-End: 152-553
tccacattgtcctttgagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaaggggatgttccaccgggaattagaaataccatctgccatatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaattta

SEQ ID NO: 185488 - DNA, 444 bp, Homo sapiens
  Payload ID: 16528
  Gene Symbol: SPAG11B
  Gene Name: sperm associated antigen 11B
  Uniprot ID: Q08648
  ENST ID: ENST00000458665
  CDS Start-End: 53-295
catatttgtgctccttcacgggagggcagggaggttcaacggaccttaaaacatgaaggtcttttttctgtttgctgttctcttttgtttggtccaaacaaactcaggggatgttccaccgggaattagaaataccatctgccatatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaggtgaagagctgataaaagacatttttttaacttcctta

SEQ ID NO: 185489 - DNA, 481 bp, Homo sapiens
  Payload ID: 16528
  Gene Symbol: SPAG11B
  Gene Name: sperm associated antigen 11B
  Uniprot ID: Q08648
  ENST ID: ENST00000528168
  CDS Start-End: 53-205
catatttgtgctccttcacgggagggcagggaggttcaacggaccttaaaacatgaaggtcttttttctgtttgctgttctcttttgtttggtccaaacaaactcagtgcacatctctcaccgggaggctcgaggaccctcatttaggatctgtgtggactttttagggcctagatgggccaggggatgttccaccgggaattagaaataccatctgccatatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaa

SEQ ID NO: 185490 - DNA, 552 bp, Homo sapiens
  Payload ID: 16528
  Gene Symbol: SPAG11B
  Gene Name: sperm associated antigen 11B
  ENST ID: ENST00000528767
  CDS Start-End: 1-162
tcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagaaatgaaatgaaggaggtgggctcgatctcagactccatcagagcacagcagcctgggggtgtggaagcagagcctcacccaaggaccaaggggtctccaccagggacaggccagcagcacagacaacgctgtggataaggagagtagagacttcctcttcctgcctcctgtcttctggagttgtgacctcagggtggcccaggtggatcggcttcagaggccaggaggcagctctctgcagccgaagagcaggagcctcacccagggtctgtggctctgactaagcctggactgcctctcggctgtgctccatggactggctccccagggatccatgtgagagaccggagtatgatcctcagtgcgaggacaaataaaagtagtgattatgtccacccca

SEQ ID NO: 185491 - DNA, 408 bp, Homo sapiens
  Payload ID: 16528
  Gene Symbol: SPAG11B
  Gene Name: sperm associated antigen 11B
  ENST ID: ENST00000528943
  CDS Start-End: 1-321
ctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagggactcactctgttgctcaggctggagtgcagtggcactgttaccgcttattgcagcctctacctcctgggctcaagtgctcctcccaccttagcctcccaaatacctgggaccaccggcatgcaccattgcacactgctagtttttttaggtgttgagccaccacttccagccccaagcttgcagctctgactacactttctccgggaagctgacactcaggcccgaatgtggctggctgccgc

SEQ ID NO: 185492 - DNA, 806 bp, Homo sapiens
  Payload ID: 16528
  Gene Symbol: SPAG11B
  Gene Name: sperm associated antigen 11B
  ENST ID: ENST00000617378
  CDS Start-End: 172-513
agcagtgggatagtagcgtgtccacattgtcctttgagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttacaaccgcgcaccccaccttaccaagaacctgcatcagatttaaaagttgttgactgcaggagaagtgaaggcttctgccaagaatactgtaattatatggaaacacaagtaggctactgctctaaaaagaaagacgcctgctgtttacattaaaactgatgttgctgatatagaaacaaagctctgccacttacctgttctccggggccacgttgtccaatcaggtgcaggttttttgcggaagtgtctgagcagcagggagcggagatattgccacttgtgccagacagttcaaatattttattgtggcaagataaatgacaaaaatgctacctgtgatcttacagaagatgacttagcttgacatgaacagaattttcaaaatcacacaatttgtgctagtaaatgtggatatcataaacttttattagaaagaattaaaataa

SEQ ID NO: 185493 - DNA, 655 bp, Homo sapiens
  Payload ID: 16528
  Gene Symbol: SPAG11B
  Gene Name: sperm associated antigen 11B
  ENST ID: ENST00000617162
  CDS Start-End: 152-553
tccacattgtcctttgagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttacaaccgcgcaccccaccttaccaaggggatgttccaccgggaattagaaataccatctgccatatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaattta

SEQ ID NO: 185494 - DNA, 795 bp, Homo sapiens
  Payload ID: 16528
  Gene Symbol: SPAG11B
  Gene Name: sperm associated antigen 11B
  ENST ID: ENST00000613163
  CDS Start-End: 168-479
gtgggatagtagcgtgtccacattgtcctttgagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttacaaccgcgcaccccaccttaccaagtgcacatctctcaccgggaggctcgaggaccctcatttaggatctgtgtggactttttagggcctagatgggccaggggatgttccaccgggaattagaaataccatctgccatatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaggtgaagagctgataaaagacatttttttaacttccttac

SEQ ID NO: 185495 - DNA, 481 bp, Homo sapiens
  Payload ID: 16528
  Gene Symbol: SPAG11B
  Gene Name: sperm associated antigen 11B
  Uniprot ID: Q08648
  ENST ID: ENST00000622314
  CDS Start-End: 53-205
catatttgctctccttcacgggagggcagggaggttcaacggaccttaaaacatgaaggtcttttttctgtttgctgttctcttttgtttggtccaaacaaactcagtgcacatctctcaccgggaggctcgaggaccctcatttaggatctgtgtggactttttagggcctagatgggccaggggatgttccaccgggaattagaaataccatctgccatatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaa

SEQ ID NO: 185496 - DNA, 612 bp, Homo sapiens
  Payload ID: 16528
  Gene Symbol: SPAG11B
  Gene Name: sperm associated antigen 11B
  ENST ID: ENST00000615672
  CDS Start-End: 24-350
ggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttacaaccgcgcaccccaccttaccaaggggatgttccaccgggaattagaaataccatctgccatatgcagcaagggatctgcagactttttttctgccattctgggacaggccagcagcacagacaacgctgtggataaggagagtagagacttcctcttcctgcctcctgtcttctggagttgtgaccgcagggtggcccaggtggatcggcttcagaggccaggaggcagctctctgcagccgaagagcaggagcctcacccagggtctgtggctctgactaagcctggactgcctctcggctgtgctccgtggactggctcctcagggatccatgtgagagaccggagtatgatcctcagtgcgaggacaaataaaagtagtgattatgtccacccca

SEQ ID NO: 185497 - DNA, 444 bp, Homo sapiens
  Payload ID: 16528
  Gene Symbol: SPAG11B
  Gene Name: sperm associated antigen 11B
  Uniprot ID: Q08648
  ENST ID: ENST00000619134
  CDS Start-End: 53-295
catatttgctctccttcacgggagggcagggaggttcaacggaccttaaaacatgaaggtcttttttctgtttgctgttctcttttgtttggtccaaacaaactcaggggatgttccaccgggaattagaaataccatctgccatatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaggtgaagagctgataaaagacatttttttaacttcctta

SEQ ID NO: 185498 - DNA, 534 bp, Homo sapiens
  Payload ID: 16528
  Gene Symbol: SPAG11B
  Gene Name: sperm associated antigen 11B
  ENST ID: ENST00000620054
  CDS Start-End: 24-272
ggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttacaaccgcgcaccccaccttaccaagggacaggccagcagcacagacaacgctgtggataaggagagtagagacttcctcttcctgcctcctgtcttctggagttgtgaccgcagggtggcccaggtggatcggcttcagaggccaggaggcagctctctgcagccgaagagcaggagcctcacccagggtctgtggctctgactaagcctggactgcctctcggctgtgctccgtggactggctcctcagggatccatgtgagagaccggagtatgatcctcagtgcgaggacaaataaaagtagtgattatgtccacccca

SEQ ID NO: 185499 - DNA, 552 bp, Homo sapiens
  Payload ID: 16528
  Gene Symbol: SPAG11B
  Gene Name: sperm associated antigen 11B
  ENST ID: ENST00000628628
  CDS Start-End: 1-162
tcgtctcaagccagacatgtgaaccactcagccactgaggctctcggagaactcagggaaagagcccctgggcaaggcacaaacgggtttcagctgctacgccacgcagtgaaacgggacctcttacaaccgcgcaccccaccttaccaagaaatgaaatgaaggaggtgggctcgatctcagactccatcagagcacagcagcctgggggtgtggaagcagagcctcacccaaggaccaaggggtctccaccagggacaggccagcagcacagacaacgctgtggataaggagagtagagacttcctcttcctgcctcctgtcttctggagttgtgaccgcagggtggcccaggtggatcggcttcagaggccaggaggcagctctctgcagccgaagagcaggagcctcacccagggtctgtggctctgactaagcctggactgcctctcggctgtgctccgtggactggctcctcagggatccatgtgagagaccggagtatgatcctcagtgcgaggacaaataaaagtagtgattatgtccacccca

SEQ ID NO: 185500 - DNA, 398 bp, Homo sapiens
  Payload ID: 16528
  Gene Symbol: SPAG11B
  Gene Name: sperm associated antigen 11B
  ENST ID: ENST00000629756
  CDS Start-End: 1-311
gatcgtctcaagccagacatgtgaaccactcagccactgaggctctcggagaactcagggaaagagcccctgggcaaggcacaaacgggtttcagctgctacgccacgcagtgaaacgggacctcttacaaccgcgcaccccaccttaccaagggactcactctgttgctcaggctggagtgcagtggcactgttaccgcttattgcagcctctacctcctgggctcaagtgctcctcccaccttagcctcccaaatacctgggaccaccggcatgcaccattgcacactgctagtttttttaggtgttgagccaccacttccagccccaagcttgcagctctgactacactttctccgggaagctgacactcaggcccgaatgtggctggctgccgc

SEQ ID NO: 185501 - DNA, 1059 bp, Homo sapiens
  Payload ID: 16529
  Gene Symbol: SPAG16
  Gene Name: sperm associated antigen 16
  ENST ID: ENST00000272898
  CDS Start-End: 106-1059
gccggaatctcgcgagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagagataccagatgacaattttagcatcccagaaggtgaagaagatctggcaaaagcaattcagatggcccaagaacaggctacagatactgaaattttggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaagttgatcatagtcgtgaaaaagaaaatgcaccagaaggtcctactcagaaaggtcttcgtgaagccagggaacaaaacaaatgtaaaacaaagatgaaaggcaatacaaaggaaaaggaattt

SEQ ID NO: 185502 - DNA, 2177 bp, Homo sapiens
  Payload ID: 16529
  Gene Symbol: SPAG16
  Gene Name: sperm associated antigen 16
  Uniprot ID: Q8N0X2
  ENST ID: ENST00000331683
  CDS Start-End: 96-1991
cgcgagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagagataccagatgacaattttagcatcccagaaggtgaagaagatctggcaaaagcaattcagatggcccaagaacaggctacagatactgaaattttggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaagttgatcatagtcgtgaaaaagaaaatgcaccagaaggtcctactcagaaaggtcttcgtgaagccagggaacaaaacaaatgtaaaacaaagatgaaaggcaatacaaaggattcagaatttcccatagatatgcaaccaaatccaaacctgaatgtttctaaagaaagtctttctccagcaaaatttgactacaagctgaaaaacatttttagactccatgaacttccagtgagctgtgtctccatgcaaccccacaaagacatcctagtctcctgtggcgaggaccgactctggaaggtgttgggccttccaaaatgcaatgtgcttctcacgggatttggccacactgactggctttcagactgctgcttccatcccagtggcgacaaattggctacttcaagtggtgacactacagttaaattatgggatctatgtaaaggcgattgcattttgacctttgaaggacacagccgcgcagtgtggtcctgcacatggcactcctgcggcaattttgtggcttcctcctcactggataaaactagcaaaatttgggatgttaatagtgaaagatgcagatgtactttgtatggacatacagattctgtgaacagcattgagttttttcctttctccaatactcttctcacaagctctgcagacaagaccctgtctatatgggatgcaagaacaggtatatgtgagcagtcactttatggtcacatgcattctatcaatgatgccatttttgatcccaggggtcacatgatagcatcctgtgatgcctgtggggttacaaagctgtgggactttcggaagctgttaccaattgtgtccatcgatataggtccaagtcctggcaatgaggtgaattttgattcatcaggtcgagttttagctcaggcaagtggcaatggtgttatccatttgctagatcttaaatctggggagattcacaaattgatgggccacgaaaacgaggcacacacggttgtgttttctcacgacggggagattctcttttctggaggctctgacggcacagttcgaacgtggtcttgaccgtcagcacatcccgctgcagagggcattccctttaaggcttgaaaatgcctcctgtagtcccaaaccagcaaagaactggttaaatgtgccagcaggtaacatttacagtctgctttaaaacatgctttggacatatattttagtgctcatactgttactaataaaaaaataactttatgctca

SEQ ID NO: 185503 - DNA, 2352 bp, Homo sapiens
  Payload ID: 16529
  Gene Symbol: SPAG16
  Gene Name: sperm associated antigen 16
  ENST ID: ENST00000406979
  CDS Start-End: 96-269
cgcgagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaaccttatctatatccagtgcccttgctactgaatgattaaaacttgacaagatattcagaggtcaccataactgaagcatctgaagatgactatgaatatgaagagataaaagcagttgcccacaaactaatcctgaatttattagaagtgacgtttattgacatttacaaggaagtcagaagaaagcagttattcatttttcatggatcttcagaatgacatgataccagatgacaattttagcatcccagaaggtgaagaagatctggcaaaagcaattcagatggcccaagaacaggctacagatactgaaattttggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaagttgatcatagtcgtgaaaaagaaaatgcaccagaaggtcctactcagaaaggtcttcgtgaagccagggaacaaaacaaatgtaaaacaaagatgaaaggcaatacaaaggattcagaatttcccatagatatgcaaccaaatccaaacctgaatgtttctaaagaaagtctttctccagcaaaatttgactacaagctgaaaaacatttttagactccatgaacttccagtgagctgtgtctccatgcaaccccacaaagacatcctagtctcctgtggcgaggaccgactctggaaggtgttgggccttccaaaatgcaatgtgcttctcacgggatttggccacactgactggctttcagactgctgcttccatcccagtggcgacaaattggctacttcaagtggtgacactacagttaaattatgggatctatgtaaaggcgattgcattttgacctttgaaggacacagccgcgcagtgtggtcctgcacatggcactcctgcggcaattttgtggcttcctcctcactggataaaactagcaaaatttgggatgttaatagtgaaagatgcagatgtactttgtatggacatacagattctgtgaacagcattgagttttttcctttctccaatactcttctcacaagctctgcagacaagaccctgtctatatgggatgcaagaacaggtatatgtgagcagtcactttatggtcacatgcattctatcaatgatgccatttttgatcccaggggtcacatgatagcatcctgtgatgcctgtggggttacaaagctgtgggactttcggaagctgttaccaattgtgtccatcgatataggtccaagtcctggcaatgaggtgaattttgattcatcaggtcgagttttagctcaggcaagtggcaatggtgttatccatttgctagatcttaaatctggggagattcacaaattgatgggccacgaaaacgaggcacacacggttgtgttttctcacgacggggagattctcttttctggaggctctgacggcacagttcgaacgtggtcttgaccgtcagcacatcccgctgcagagggcattccctttaaggcttgaaaatgcctcctgtagtcccaaaccagcaaagaactggttaaatgtgccagcaggtaacatttacagtctgctttaaaacatgctttggacatatattttagtgctcatactgttactaataaaaaaataactttatgctca

SEQ ID NO: 185504 - DNA, 2258 bp, Homo sapiens
  Payload ID: 16529
  Gene Symbol: SPAG16
  Gene Name: sperm associated antigen 16
  ENST ID: ENST00000413312
  CDS Start-End: 247-1002
agcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacgtatccttcccgtggaggcgcggcccgctgcgctggcgggtaatgggtgttgggacgaaggcgagggcctcccactggcggcgccttttgagccttggggccactccggaggagcctctgttggacttcaagataccagatgacaattttagcatcccagaaggtgaagaagatctggcaaaagcaattcagatggcccaagaacaggctacagatactgaaattttggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaaggtaaatgtaaaatgtgatgaagctctcatttaatatagtttggtgatttctcaaccttatcagtgattaatattctagagatatttaaaggtgagtaagtggtggctatttcacaaattaaaattttaataaaaagattaagaagaaatatagatatcatactgtatggattaattatagagaaaaacaagtcaactataatggaaggacttctgcttctggtcattatacctggtaccagactagccttctctgtgtaaataactctaaagctaagctgtaagatcagacaactacttttaggcagtagaaaacagacagctcaagtaacagaaggcaattgacagaaggaaaatttataaggtgagctctgccatcaccatggctttgggtctgtggaaagttccaaactgagctttgtggagatggaagccaataagagcatgacaatcctgataattggaaatgtcagagaccctagttcacagcttttgaagccactggaatctgtagggaaagacaccagagaagagagctgcaatgaggagtggctcagtttgtgagggagtttactatgagtccttagctgaggctgcaatactatacataacaacactacctgacacttacaagagagatacaattatataggatcaagaggaggccagagattgtagaagttaagtagtgatgcgaaacattgcaaatctggccatgcctgggtggaaagacctctttcacaccttgttaacaacacagtaacattcagcatcccatatccgccttataaaaccaggaacaaagcttacacagcattcttagagaggacacagaatttggagtttgagtcttgccaagttatagggccttgagaaacatttagggctttccatggatccaccctaacgaagcataaaattaagcctaggattttagggtcatcagccaaaaatggaactgccttctagaacaaaaaatgacatccttttgaggaagacagtcatccagagtctttacaatcttttacccacattgcctagtacataattaaacatttctagatatgaataggaacaggaaaatgtgacccataatcaagacaacaagcaataaatggaaacctacccttaagtagctaaactgttgcatttagcagatagaaagtgctaaagtagatactttgattatgttcaaggacttaatggaaaatactaataagtgaacagatggggaatttaagcaaagaaatgagaacaagcatacattccaaagc

SEQ ID NO: 185505 - DNA, 4751 bp, Homo sapiens
  Payload ID: 16529
  Gene Symbol: SPAG16
  Gene Name: sperm associated antigen 16
  ENST ID: ENST00000452556
  CDS Start-End: 30-224
gctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagaggtaacatgttaattttagataccagatgacaattttagcatcccagaaggtgaagaagatctggcaaaagcaattcagatggcccaagaacaggctacagatactgaaattttgcaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaagttgatcatagtcgtgaaaaagaaaatgcaccagaaggtcctactcagaaaggtcttcgtgaagccagggaacaaaacaaatgtaaaacaaagatgaaaggcaatacaaaggattcagaatttcccatagatatgcaaccaaatccaaacctgaatgtttctaaagaaagtctttctccagcaaaatttgactacaagctgaaaaacatttttagactccatgaacttccagtgagctgtgtctccatgcaaccccacaaagacatcctagtctcctgtggcgaggaccgactctggaaggtgttgggccttccaaaatgcaatgtgcttctcacgggatttggccacactgactggctttcagactgctgcttccatcccagtggcgacaaattggctacttcaagtggtgacactacagttaaattatgggatctatgtaaaggcgattgcattttgacctttgaaggacacagccgcgcagtgtggtcctgcacatggcactcctgcggcaattttgtggcttcctcctcactggataaaactagcaaaatttgggatgttaatagtgaaagatgcagatgtactttgtatggacatacagattctgtgaacagcattgagttttttcctttctccaatactcttctcacaagctctgcagacaagaccctgtctatatgggatgcaagaacaggtatatgtgagcagtcactttatggtcacatgcattctatcaatgatgccatttttgatcccaggggtcacatgatagcatcctgtgatgcctgtggggttacaaagctgtgggactttcggaagctgttaccaattgtgtccatcgatataggtccaagtcctggcaatgaggtgaattttgattcatcagaaaataccacgtatctttatagactaggagctcagatatattatttccagctttcttgatgttacctcaaattgaagttgccaatggtaggactgcacaatctgaatacatatgatgagatattttatgcctcgttttccatctgcttgagttagcaccctttcaccattggccatttcatactacccaatttccatgtaatttgtctctctaatcttgtcagccccttgaaatgaaggtgcactttattcagggattattttcatgctcaagatcattttgtgaattattttatatcattataaataatcctactgttaccttttcaatacaagaatttgatttcccagcattaatgggttcattcaatagtagtgccaagttcatacagcaacactgtaattgcattttaatcagaaactagtaatatatgctgaagatactttgttaaattaacattattgctgtgattaacaaagcacactgttaagtgaatattgcatgaattaaattacatactagatcacttacatagtttaggatttcatgtgctatctagctacctcttcccacaaaatctacatccttatctgttttactcataaaaatgtaattcttgaagctcataagcatagctacttaaatgattcctttgcttaatagaaacatctttgttcactacaacaagcttatctgcactacattttttaggaataaaggatatgtgatatgtattatttgaaaactggcattcaattgccacacttggctgttcaccataaaactcctatttgaaatctaactttgaggacttctttgaggatactagagttatagttctgaaatagttacttgcagaaatgctatctattaatttaaattttggtttaaaaaactcataatatttttttttgagacaaggattcactctgttgcccaggctggagtgcaatagcacagtcagagcatattgcagccccaaacttgtggcctcaagtaattctcctcctttagcctccagaatagctaagactacaggcaagcaccaccatgcctggctaaatttttttttgaatgttgtagaaatggagtgccactatgttgcccaggctggtcacaaattcctgtcctcaagcaatcctcccaaagtgctaggattactggcatgagccactgcacccagccttaatcatttttagtgcacagtttagtggtattaattatagtcatgttgttgtaccacagatctctagaactttttcattttgcaaaactgacactctgtacccattaaacaataaatcctcattttcaaaatgagatagcttctctagatttagtaaagctctcttctttttcattattttgcttttctgtgaaaggggacttcaaatttattttgaggaaacaaatgtaaacactcatcttaaagtatgtatattaagactattttaataatcagagcaaactttcatttatttagctattttcagtttgcagcctaccatgccaaacattactttattgctgttccctgcagtccttttgacaaggatggagcactgtcagagctgcactggagctggagacagggatagaggacactcaggatgacagcccccacccagaatcctggagaggaaagttgctattgttgaaaacataatggatctggttgttattaaagtacctgaagtcagctgcataaattgggaagcatatgcacgcttctgctttactgtggcaatttaaaacaatataaatttcataaaattctcattgaaaaaaaatgaccaagaaaagccctaaaaatagtaggaaatgttacccatcattacatcctccaccatcaaggccaagtagtcaatacccacgccagataagcactgtgtgcctatgtgaggtggtcattaaagaatgatgaggaaaggaccacagaaatcaactggtgtcttcccaaagtcctggggacgctgaggaacacacatgggtctcataatgtccatgtccttcccttatacctcaatgctctttccaccttgccctggtggaaagtcttgtccatatcacctctaatccagcattctcaaagcagcacaaaactgtcttcagaagactgaatgtttctacattccttcatattaattccaggaaaagaattcccaagtcaaataattcaaatgctaagtgtattttttaaaattgtttttaggcactttctcttaggaatgtaaactctttgagggcagggtctatgtcctttcatcattgtgttcatcaggctttatcattgtctagcatatggtggatggataaacaaccatctccgtaaagatatctgatttctattccaactacacaagctccttttctagtatacacagccaccaaaataatgcttaaaacatatgtctcagaatgacaatcaagatagaagtcttaaagcaagaaagatgttttccttgtttgttcttctataaattctctaaagattcataaaatttagctatacaatctacttcagataatggcttctagatgctatgtagaaattggcccattatgcaagataaaaatcatctaagattataatgcaaatcagtcatcataaaaaatataaagatctagaatttatagaaattctactgagcatttattttatgtgaaagaaaaatacatccacagtacatacataattaaatgtaaatgtatgctgaaaaagttcataatcatgaaaaatacatatcttgatggactacttttatttggcaacctttaccttccaatatctgtcataatattagagtagattagaaattatatctacagtctcaactcattttatgaaatatgagtaacggtaggtatagataatttattttccctcagctgtacataaagatggataattacatctttctaaaaaaatgaagctgaccaggcgcggtggctcacgcctgtaatcctagcactttgggaggccgaggtgggtggattgcttgagctcaggagttcaaaaccagcatgggcaacacagtgaaactctgtctctactaaaaatacaaaaaaaaattagccgggtgtggcgatgtgcgactgtagttcccagttattcgaaaagctgaggcaggagaattgcttgaacctgagaggcggagcttgcagtgagcggagatcacgccactgcactccagcctgggcgacagagcaagactccgttgccaaaaaaaaaaaaaaaaaa

SEQ ID NO: 185506 - DNA, 1330 bp, Homo sapiens
  Payload ID: 16529
  Gene Symbol: SPAG16
  Gene Name: sperm associated antigen 16
  ENST ID: ENST00000447990
  CDS Start-End: 4-1128
gagatggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagagataccagatgacaattttagcatcccagaaggtgaagaagatctggcaaaagcaattcagatggcccaagaacaggctacagatactgaaattttggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaagttgatcatagtcgtgaaaaagaaaatgcaccagaaggtcctactcagaaaggtcttcgtgaagccagggaacaaaacaaatgtaaaacaaagatgaaaggcaatacaaaggtgatgagaaggagagaagagctgtggcccttcagggagcccagacctagaagctccacgagccagtgctgtgacaccctctttggggctgtgcagtttcagatgtttccaagcatccagacgccactgaattctcatccagatttgggtgcccacagcagaagttgcttggagtgcatctgatccagctccaggcttacacagatccagtgcctgtgccagtgcctggagctgcctgccccactgcagcagctggcatgcctggctgtgcacagtggctggacctggttctcacttgctcacacacccctcacctctctgctcctggcttgcctttggctggtgtggaatctgggctgtagcaagagctgagcacagcctacca

SEQ ID NO: 185507 - DNA, 805 bp, Homo sapiens
  Payload ID: 16529
  Gene Symbol: SPAG16
  Gene Name: sperm associated antigen 16
  ENST ID: ENST00000440779
  CDS Start-End: 48-332
agggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagagataccagatgacaattttagcatcccagaaggtgaagaagatctggcaaaagcaattcagatggcccaagaacaggctacagatactgaaattttggtatgagttaatacagaaaggagtgactgaacttagaactgttgggaatgttccagatgtctacacccagattatgcttttggaaaatgagaacaaaaatttaaagaaagatttgaagcactacaaacaagcagctgacaaagctagagaagatttgctgaaaattcagaaagaacgtgattttcatcgaatgcatcataagcgaatagtccaggaaaaaaacaaattaattaatgacctcaaagggttgaagttacattatgcatcttatgaaccgactataagggtgttacatgagaaacaccacactttactgaaggagaaaatgctgacctccttggaaagagacaaagtagttgggcagatttctggacttcaagaaacattgaagaaactgcaaagaggacatagttaccatggtcctcaaattaaagttgatcatagtcgtgaaaaagaaaatgcaccagaaggtcctactc

SEQ ID NO: 185508 - DNA, 514 bp, Homo sapiens
  Payload ID: 16529
  Gene Symbol: SPAG16
  Gene Name: sperm associated antigen 16
  ENST ID: ENST00000420497
  CDS Start-End: 48-344
agggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagagataaaagcagttgcccacaaactaatcctgaatttattagaagtgacgtttattgacatttacaaggaagtcagaagaaagcagttattcatttttcatggatcttcagaatgacatgataccagatgacaattttagcatcccagaaggtgaagaagatctggcaaaagcaattcagatggcccaagaacaggctacagatactgaaattttgcacctttcatggtacctggtacatgggagatgttcaccaattatatgttgaataaatatcctacgtaaag

SEQ ID NO: 185509 - DNA, 1250 bp, Homo sapiens
  Payload ID: 16529
  Gene Symbol: SPAG16
  Gene Name: sperm associated antigen 16
  Uniprot ID: Q8N0X2
  ENST ID: ENST00000432529
  CDS Start-End: 93-644
gagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacaggtcaccataactgaagcatctgaagatgactatgaatatgaagagataccagatgacaattttagcatcccagaaggtgaagaagatctggcaaaagcaattcagatggcccaagaacaggctacagatactgaaattttggaacggaaaacagttcttccttcaaagcatgcagtacctgaagtaatagaagactttctctgcaatttcttgatcaaaatgggaatgaccagaactcttgattgctttcagtctgaatggtatgagttaatacagaaaggagtgactgaacttagaactgttgggaatgttccagatgtctacacccagattatgcttttggaaaatgagaacaaaaatttaaagaaagatttgaagcactacaaacaagcagctgagtatgttattttttaaatgacattttcttctttttcttttggactaaataaaagagttgagtgaagctgatatatgtaatataccagagccttaatttttgaaaactgaatttttctagttgtaaagaatgtgagaggcttcattagcaaattaattaaacagatgatcagaactatcacaattataacttaccaacaagaagggaatgcaggtagttgtttaggagatggtacattttttatataacattcacttccttgtgtatttgatagtcttttcatggtttataacattttctcctgtaaagataggctaatttctgaaataataattaaatttatagaaagccgagaggaaattgctagtttattcctggtagaggaatttctgtatttgaaaattctccagaaggaataatataaactgtggactttgggtgataatgatatgtaggttcgtcagttgttaacaaatgtatccctctgttgggggctattgataatggggaaggctgtgcatgtgtgggagtaggaggtgtatgggacatctctgtaccttctaatcaattttgctatgaacttaaaactgctctaaaaataaagtttattaaaaaaaagttaa

SEQ ID NO: 185510 - DNA, 771 bp, Homo sapiens
  Payload ID: 16529
  Gene Symbol: SPAG16
  Gene Name: sperm associated antigen 16
  ENST ID: ENST00000451561
  CDS Start-End: 1-768
gattcagaatttcccatagatatgcaaccaaatccaaacctgaatgtttctaaagaaagtctttctccagcaaaatttgactacaagctgaaaaacatttttagactccatgaacttccagtgagctgtgtctccatgcaaccccacaaagacatcctagtctcctgtggcgaggaccgactctggaaggtgttgggccttccaaaatgcaatgtgcttctcacgggatttggccacactgactggctttcagactgctgcttccatcccagtgaaagatgcagatgtactttgtatggacatacagattctgtgaacagcattgagttttttcctttctccaatactcttctcacaagctctgcagacaagaccctgtctatatgggatgcaagaacaggtatatgtgagcagtcactttatggtcacatgcattctatcaatgatgccatttttgatcccaggggtcacatgatagcatcctgtgatgcctgtggggttacaaagctgtgggactttcggaagctgttaccaattgtgtccatcgatataggtccaagtcctggcaatgaggtgaattttgattcatcaggtcgagttttagctcaggcaagtggcaatggtgttatccatttgctagatcttaaatctggggagattcacaaattgatgggccacgaaaacgaggcacacacggttgtgttttctcacgacggggagattctcttttctggaggctctgacggcacagttcgaacgtggtcttgaccg

SEQ ID NO: 185511 - DNA, 6924 bp, Homo sapiens
  Payload ID: 16530
  Gene Symbol: SPAG17
  Gene Name: sperm associated antigen 17
  Uniprot ID: Q6Q759
  ENST ID: ENST00000336338
  CDS Start-End: 67-6738
ggtagcggggacgcttaggcagggcctgcgcccagtttagaggccaatgcttctcccgtcctttgcatggcacccaagaaggagaaaggaggaactgtgaacaccagttctaagatatgggaaccctcgctcatagctgcacagttcaatcagaacgattggcaggcctccattgcttttgtggttgggaaccagattgaagatgatcttctcatccaagcccttaccgtggctgtccaggtccctcagcgtaaactcttcagtatggtgtcgtggcaagacattctccagcagattaatgaaataaatacacttgttggatctgcttcatctaaaaaggcaaaaaaacctgtaggtggtaatgctcctttatattatgaggtgttaacggcagcaaaagcaattatggatagtggagagaaattaaccttaccactgatagggaaactcttgaaatttcaacttctccagattaaatttaaggaccaacagcgacgggaaaatgaaaagaaggtaatagaagacaaacctaagttagaaaaggataaagggaaagcaaaatctcccaaggagaaaaaggctccaagtgccaagcctgccaaaggaaagggaaaggatcagcctgaggcaaatgcaccagtgaaaaagaccacccagttaaagcggagaggagaagacgaccacaccaatcgttacattgacgatgagccagatgatggtgcccaacattacattatagttgtgggctttaacaatcctcagctattagcaattatggctgagcttggcattcctataaccagcgtgattaaaatatcttcagagaattatgaacctctgcagacacacctggcagcagttaaccagcagcaggaagttcttcttcagtcagaagatctagaagcagaaaaattgaagaaagaaaatgccataaaagagcttaaaactttctggaagtacttggaaccagtcctgaataatgagaaacctgaaacaaatctctttgatgttgctcgacttgagtacatggtcaaagcagctgattttccttctgactggtcagatggtgagatgatgctgaaattgggcactgatatttttgaaaatattgcctgcttgatgtatgacatcctggattggaaaaggcagcaccagcactatttggaaagcatgcagcttattaatgttccacaagtggttaatgagaaacctgtattagaagccatgccaacttcagaggctccacaacctgctgtaccagctcctggaaagaagaaagcacagtatgaagaaccgcaagctccaccaccagtgacttcagtcatcacaactgaagtagacatgagatattacaattatttgctgaatccaattcgagaggaattcatttctgtgcccctgatactgcattgtatgctggaacaggttgttgcaactgaagaagatctcgtcccacccagtctgcgggagccatcccccagagcagacgggctagaccacagaatcgcagctcacattgtgtcccttctgccctcactctgtctctcagagagggagaaaaagaatcttcatgacatatttttatctgaagaagaaaatgaaagcaaagcagtgcccaaaggccccctcctactgaactatcatgatgcacacgcccacaagaagtacgcactacaggaccaaaagaattttgatccagttcaaattgagcaggagatgcagtccaagttgccactgtgggaatttcttcaattccctctacccccaccatggaacaacactaaacgtctagctacaattcatgagcttatgcacttttgtacgagtgatgtcttgagctggaatgaagtagaacgagccttcaaggtgtttacttttgagagcctgaagctctctgaggttgatgaaaaagggaaactgaaaccttctgggatgatgtgtgggtcagattctgaaatgttcaacataccgtgggacaaccctgccagatttgctaaacagataaggcagcaatatgtcatgaaaatgaatactcaagaggccaagcagaaagcagatattaaaatcaaagacagaacactatttgtggatcagaatttgtcaatgtctgtgcaagataatgaaagcaaccgagaaccttcagatcctagtcagtgtgatgctaacaatatgaagcattctgacttgaataatctcaaactctcagtccctgataatagacagctgttagagcaggagagcatcatgaaggctcagccccaacatgagtctctggagcagaccacaaacaatgagatcaaagatgatgcagtcacaaaggctgattctcatgaaaagaaacccaagaagatgatggtggaagcagatttagaggacataaagaaaacacagcagcgcagtctaatggactggagttttactgaacattttaaaccgaaagtactgcttcaggtccttcaagaagcccataagcaatataggtgtgttgattcttactaccacacccaagacaactctttacttttagtctttcacaatccaatgaatagacaacgtttgcattgtgaatattggaacattgctctccactccaatgttggattcaggaattatttggaacttgttgcaaaatctattcaagattggattacaaaagaagaagctatatatcaggaatctaaaatgaatgagaaaatcatcaggaccagagctgagctggaattgaaatcttctgctaatgccaaacttacttctgctagcaaaattttttccattaaagaatctaaaagtaacaaaggaatcagcaaaacagagatatcagatcaagaaaaagaaaaagagaaggaaaagattcctttcattttagaaggctctctcaaggcatggaaagaagagcaacatcgattagcagaagaggagcgcttaagggaagaaaagaaagcagagaagaagggtaaagaagctggtaaaaagaaaggcaaggataacgcagagaaagaggatagtaggtctttgaagaaaaaatcaccttacaaggagaaatctaaagaagaacaagtcaagatccaagaagtaacagaagagtccccccaccaaccagaacctaagataacttacccgtttcacggatacaatatgggaaatatacccactcaaatctcagggtcaaattactacctgtatccttctgatggggggcagattgaagtggaaaagacaatgtttgaaaaaggcccaacttttatcaaagtgagagtggtaaaggacaaccacaattttatgattcatttaaatgaccctaaggaaattgtgaaaaaggaagagaaaggggattattatttagaagaggaagaagaaggagatgaggaacaaagtcttgaaacggaagtatcagatgcaaagaataaagctttcagcaagtttggatctttttctgccaccttagaaaatggaatctgcctctcgataagttactatggatcaaatggaatggcaccagaagataaggatcctgatttagaaacaatattgaatatcccttcagcactcactccaacagtggttcctgttatagtgaccgttcctcaaagcaaagctaaagggaaaataaaaggcaaagaaaaacccaaagaatcccttaaagaagaagaacacccaaaagaagaagagaaaaaggaagaagaagtagaaccagaacctgttttacaagagactttggatgttcccaccttccagagcctaaatgtgtcttgccccagtgggctcctgttgactttcattggacaagaatctacaggtcaatatgttatagatgaggaacccacctgggacatcatggtccgtcagagctacccccagagggtgaagcactatgagttctataaaacggtgatgccacccgcagagcaggaggcttcaagggttatcaccagtcaaggcactgttgtcaaatatatgttggatggatccacacagattctctttgcagatggtgctgtgagcaggagtcccaattcaggtcttatttgtcctccttctgaaatgccagcaacgcctcacagtggagatttgatggactctatttctcagcagaaatcagaaacgataccatctgagattaccaacacaaagaaaggaaaaagtcacaaaagtcagtcatcaatggcccataagggtgaaatccatgaccctcctccagaggcagttcaaactgtaactcctgtggaggttcacataggcacctggtttacaaccacacctgaaggaaatcggatcggcaccaaaggattagaaagaatagcagacttgaccccattgttatcctttcaggccacagatcctgtcaatggaacggttatgacaactcgagaagacaaagttgtcatagttgaaaggaaagatggtactcggatagtggatcatgctgatggtaccagaatcacaaccttttatcaagtttatgaagatcaaattattctgccagatgatcaagaaacaaccgagggtcctcggactgtcaccaggcaggtgaagtgtatgcgggtagaaagctcacgctatgccactgttatcgccaactgtgaggacagtagctgctgtgccacctttggagatggaacaactattattgcaaagccacagggaacataccaggtgttacctccaaacacaggctctctttatattgacaaggattgttcagctgtgtactgccatgagtcaagcagtaatatatactatccttttcaaaagcgtgagcagctgcgagctggcaggtacatcatgaggcatacttcagaggttatctgtgaggttctggatcctgagggaaacacttttcaggtcatggctgatggtagcatatcaactatattacctgaaaaaaaattggaagatgatttaaatgagaaaactgagggctatgatagtctgtcctctatgcaccttgaaaagaatcatcagcaaatctatggtgaacatgtccccaggttttttgttatgtatgctgatggatcaggaatggaacttcttcgagacagtgacatagaagaatatctatctttggcatataaagaatcaaatactgttgttctccaagagccagtgcaggaacagccaggcaccctaaccatcacagtccttcgccctttccatgaagcatcaccatggcaagtaaaaaaggaagatacaattgtccctcctaatctccggtcaaggtcatgggaaacatttccctcagttgagaaaaaaactccaggacctccgtttggtactcagatttggaaaggcctttgcattgagtccaaacagctagtgagtgccccgggtgccatactcaagagccccagtgtgctacagatgcgccaattcattcagcatgaggtcataaagaatgaggtgaaactgaggctgcaggtttcccttaaggattacataaactatattctaaagaaagaagatgagctgcaggaaatgatggttaaagattccagaactgaggaggagagaggcaatgctgctgatctcctcaagctggttatgtctttccctaaaatggaggaaactacaaaaagtcatgttactgaagttgcagctcacctaactgatttattcaagcagtctttggctacgcctccaaaatgcccaccagacacatttggtaaagatttctttgaaaagacatggagacacacagcatcctcaaaacgctggaaagaaaagatagacaaaacgaggaaggaaattgagacaacacagaattacctaatggatattaagaaccgcataataccacccttttttaaatctgaattgaaccagttatatcagtctcagtataatcacctggacagtctttccaaaaaactgccttcttttacaaagaaaaatgaagatgcaaacgaaacagctgttcaagatacatctgatcttaatctagatttcaagccacataaggtttcagaacagaaatcctcaagtgtgcctagtcttccaaaaccagagatttctgcagataagaaggatttcactgctcagaaccaaactgaaaatttaacaaaatctcctgaagaagcagaatcttatgagcccgtgaaaattccaacccagtccttgctgcaggatgttgcgggacaaacaagaaaagaaaaagtgaagttgcctcattatttgctgagttccaagcctaagtctcaacctcttgcaaaggtgcaagattctgttggaggaaaagtgaacacatcctctgttgcatctgctgccattaataatgcaaagtcatccctttttgggttccatcttctcccatcatcagtcaagtttggagtgcttaaggaaggacatacctatgccacagttgtaaagctcaagaatgttggagtggacttctgcaggtttaaagtaaagcagcccccacccagcacaggactgaaagtgacttacaaacctggacctgtggcagctggtatgcagacagaactgaatatagagttatttgccacagctgttggagaggatggggccaagggatcagcacacatctctcacaatatcgagattatgacagagcatgaggttctgttcctacctgtggaagcaactgttttaacaagcagcaattatgataaacgaccaaaagactttccccagggaaaagaaaatccaatggtccagagaacttctacaatttattcctccacacttggagtcttcatgtctcgtaaagtttctccacattagtttcttctcggtacaactcaatagcctccataatcctctcagcctacagaggatgagaaaggaaagaagtcatcacaacatactccatcatcccaggacactgaaactggaagaactgaccagaaatttgccaaatgaaatagcttcaatctgtttaataaagacgtgcgaatagagtgccaaaaa

SEQ ID NO: 185512 - DNA, 3484 bp, Homo sapiens
  Payload ID: 16530
  Gene Symbol: SPAG17
  Gene Name: sperm associated antigen 17
  ENST ID: ENST00000437255
  CDS Start-End: 1-1983
attgcaaagccacagggaacataccaggtgttacctccaaacacaggctctctttatattgacaaggattgttcagctgtgtactgccatgagtcaagcagtaatatatactatccttttcaaaagcgtgagcagctgcgagctggcaggtacatcatgaggcatacttcagaggttatctgtgaggttctggatcctgagggaaacacttttcaggtcatggctgatggtagcatatcaactatattacctgaaaaaaaattggaagatgatttaaatgagaaaactgagggctatgatagtctgtcctctatgcaccttgaaaagaatcatcagcaaatctatggtgaacatgtccccaggttttttgttatgtatgctgatggatcaggaatggaacttcttcgagacagtgacatagaagaatatctatctttggcatataaagaatcaaatactgttgttctccaagagccagtgcaggaacagccaggcaccctaaccatcacagtccttcgccctttccatgaagcatcaccatggcaagtaaaaaaggaagatacaattgtccctcctaatctccggtcaaggtcatgggaaacatttccctcagttgagaaaaaaactccaggacctccgtttggtactcagatttggaaaggcctttgcattgagtccaaacagctagtgagtgccccgggtgccatactcaagagccccagtgtgctacagatgcgccaattcattcagcatgaggtcataaagaatgaggtgaaactgaggctgcaggtttcccttaaggattacataaactatattctaaagaaagaagatgagctgcaggaaatgatggttaaagattccagaactgaggaggagagaggcaatgctgctgatctcctcaagctggttatgtctttccctaaaatggaggaaactacaaaaagtcatgttactgaagttgcagctcacctaactgatttattcaagcagtctttggctacgcctccaaaatgcccaccagacacatttggtaaagatttctttgaaaagacatggagacacacagcatcctcaaaacgctggaaagaaaagatagacaaaacgaggaaggaaattgagacaacacagaattacctaatggatattaagaaccgcataataccacccttttttaaatctgaattgaaccagttatatcagtctcagtataatcacctggacagtctttccaaaaaactgccttcttttacaaagaaaaatgaagatgcaaacgaaacagctgttcaagatacatctgatcttaatctagatttcaagccacataaggtttcagaacagaaatcctcaagtgtgcctagtcttccaaaaccagagatttctgcagataagaaggatttcactgctcagaaccaaactgaaaatttaacaaaatctcctgaagaagcagaatcttatgagcccgtgaaaattccaacccagtccttgctgcaggatgttgcgggacaaacaagaaaagaaaaagtgaagttgcctcattatttgctgagttccaagcctaagtctcaacctcttgcaaaggtgcaagattctgttggaggaaaagtgaacacatcctctgttgcatctgctgccattaataatgcaaagtcatccctttttgggttccatcttctcccatcatcagtcaagtttggagtgcttaaggaaggacatacctatgccacagttgtaaagctcaagaatgttggagtggacttctgcaggtttaaagtaaagcagcccccacccagcacaggactgaaagtgacttacaaacctggacctgtggcagctggtatgcagacagaactgaatatagagttatttgccacagctgttggagaggatggggccaagggatcagcacacatctctcacaatatcgagattatgacagagcatgaggttctgttcctacctgtggaagcaaatatcctttaaagttcaacttgagtaatcatatatagtgcagaaattacacgagtgaggaaaacatggaagtcaaaatgcatctctactttattaattctatcttcaaaatcagagttaaatttattaagacaaagagcatcttcattcatctttgaaagcacctagccaaatctaaaaaaatacctgacacatagtatatgtgcagtaacttcagattgaataaatgtaaatgttattggctatctacggaatatcagacagaataataaaacagcaagtatctatcacaaaaaaattataattttatggaaggataggaaataccttattattataaaggttgggtattcactgaattatgcatgcattcctccttatcagtgtcttcagccaaacagatattagatagatatcaagaacctattacctccaaggtactgtataaaatagtttatcatatataaaaatggataattggactctgtcttaaaaggtattatataatttgtagcagaaataaagtcttcacattttatttctattttgtactttctccagtggcatgaattgtgtgctgcttgtgttacagttctctatttatttgatttttgagctggatcttatagaatgtgaaaacttgattgacgggaactttaagtaaaaataatgaacaaaaccatggcaacaggaaagctccaggtgtttgggatgattggcagggagttcaacttgccaaaagcttgagtattaggaatatagtgggaaagtaggttggagtcaagttatgaaagatcttaaatccttggcttgaattttattatttaagcagcagtgaaccactgcagattcctgaccctgtgggtgacatgatcagcatatctttattaagatgaatccagggttattgtgcaggacatgtcaaaggggaacaactggatgtgtaaaagtaccattagaagtctacctgaatgggccatgtgtgaggacaagaactgggagtgggggaacagtcaacataaaagagggacatgaatgaaagacatggtgggggaaggaaactgcaaaatctgaggtagaagccattgatggatggaagaaagaggacatcgagttcaacttcaaagttttgggctgaggtaatgaatcatgtatatgtaatattagatctcaactgagaagtcagaattggagatataataattttaagcatcgtttacacagaggtgatggctgaatgtatgggcaaggaacagaaatctggagtcggtttagggagcaggaggaagaagagccagtggagacaaaagcagcaattagaaaatggtgaaatacttcaaaagccttaggaagaatttcaaggaaaagacggacacaattgacggatgctattgagatgtcaaagaaaattcagatttaaagtgttaaatttggttgggataaaaactaaattgcaaaaggtaaagaatgactgtattaagaaagcagaaacattagttatggatattctttc

SEQ ID NO: 185513 - DNA, 1453 bp, Homo sapiens
  Payload ID: 16531
  Gene Symbol: SPAG4
  Gene Name: sperm associated antigen 4
  Uniprot ID: Q9NPE6
  ENST ID: ENST00000374273
  CDS Start-End: 113-1426
tcacgcagggtccgtggggtccccgcggcgcgcagcggctgaaggaggccccagggccttggcgaccgcagcggcggctttagcgtcagtgactaggcagcagggggtcaggatgcggcgaagctcccgcccgggctcggcctcgtcctcgcgcaagcacacgcccaactttttcagcgagaacagctcaatgagcatcacctcggaggacagcaaagggctccggtcagcggagcccgggcctggggagcccgagggcagaagagcccggggcccgagctgcggtgagcccgccttgagcgcgggagtgcccggaggaaccacatgggcaggaagctctcagcagaagccagcgcctcggagccacaactggcagacagcctgtggcgcggcaaccgtgaggggcggggcctcggaaccgactgggtctccagtagtctctgaggagccgctcgaccttctcccgaccctggatctgaggcaggagatgcctcccccgcgggtgttcaagagctttctgagcctgctcttccaggggctgagcgtgttgttatccctggcaggagacgtgctggtcagcatgtacagggaggtctgttccatccgcttcctgttcacggctgtgtcgctgctgagcctctttctgtcagcattctggctggggcttctgtacctggtctctcctttggagaatgaacctaaggagatgctgactctaagtgagtaccacgagcgcgtgcgctcccaggggcagcagctgcagcagctccaggccgagctggataaactccacaaggaggtgtccactgttcgggcagccaacagcgagagagtggccaagctcgtgttccagaggctgaatgaggattttgtgcggaagcccgactatgctttgagctctgtgggagcctccatcgacctgcagaagacatcccacgattacgcagacaggaacactgcctacttctggaatcgcttcagcttctggaactacgcacggccgcccacggttatcctggagccccacgtgttccctgggaattgctgggcttttgaaggcgaccaaggccaggtggtgatccaactgccgggccgagtgcagctgagcgacatcactctgcagcatccaccgcccagcgtggagcacaccggaggagccaacagcgccccccgcgatttcgcggtctttggcctccaggtttatgatgaaactgaagtttccttggggaaattcaccttcgatgttgagaaatcggagattcagactttccacctgcagaatgaccccccagctgcctttcccaaggtgaagatccagattctaagcaactggggccacccccgtttcacgtgcttgtatcgagtccgtgcccacggtgtgcgaacctcagagggggcagagggcagtgcacaggggccccattaaacatgctgatttttggagtagaattga

SEQ ID NO: 185514 - DNA, 827 bp, Homo sapiens
  Payload ID: 16531
  Gene Symbol: SPAG4
  Gene Name: sperm associated antigen 4
  ENST ID: ENST00000454819
  CDS Start-End: 184-827
gagagacttcccagctgtctggcttgtggactgagcaatctgcggcccggtctcgaggggaaaataggtctgtggtccgcaaggccccagtggagcccttgggttcccgcagaaccgactgggtctccagtagtctctgaggagccgctcgaccttctcccgaccctggatctgaggcaggagatgcctcccccgcgggtgttcaagagctttctgagcctgctcttccaggggctgagcgtgttgttatccctggcaggagacgtgctggtcagcatgtacagggaggtctgttccatccgcttcctgttcacggctgtgtcgctgctgagcctctttctgtcagcattctggctggggcttctgtacctggtctctcctttggagaatgaacctaaggagatgctgactctaagtgagtaccacgagcgcgtgcgctcccaggggcagcagctgcagcagctccaggccgagctggataaactccacaaggaggtgtccactgttcgggcagccaacagcgagagagtggccaagctcgtgttccagaggctgaatgaggattttgtgcggaagcccgactatgctttgagctctgtgggagcctccatcgacctgcagaagacatcccacgattacgcagacaggaacactgcctacttctggaatcgcttcagcttctggaactacgcacggccgcccacggttatcctggagccccacgtgttccctgggaattgctgggcttttgaaggcgaccaaggccaggtggtgatccaactgccgggccgagtgcagctgagcgacatcactctgcagcatccacc

SEQ ID NO: 185515 - DNA, 453 bp, Homo sapiens
  Payload ID: 16531
  Gene Symbol: SPAG4
  Gene Name: sperm associated antigen 4
  ENST ID: ENST00000430878
  CDS Start-End: 1-426
gtgttccctgggaattgctgggcttttgaaggcgaccaaggccaggtggtgatccaactgccgggccgagtgcagctgagcgacatcactctgcagcatccaccgcccagcgtggagcacaccggaggagccaacagcgccccccgcgatttcgcggtctttttcctcctttcattcttcacccaccagggcctccaggtttatgatgaaactgaagtttccttggggaaattcaccttcgatgttgagaaatcggagattcagactttccacctgcagaatgaccccccagctgcctttcccaaggtgaagatccagattctaagcaactggggccacccccgtttcacgtgcttgtatcgagtccgtgcccacggtgtgcgaacctcagagggggcagagggcagtgcacaggggccccattaaacatgctgatttttggagtagaattga

SEQ ID NO: 185516 - DNA, 4040 bp, Homo sapiens
  Payload ID: 16532
  Gene Symbol: SPAG5
  Gene Name: sperm associated antigen 5
  Uniprot ID: Q96R06
  ENST ID: ENST00000321765
  CDS Start-End: 334-3915
caggagggatggactcctggactctccagctacctgcgtggtcctccccggtgtgaggacagaagaccggtcctgggccgggcccgcatccagccctaccgccggtgtctgaggtgagggctccgtcagcggaaaacgctcgacaacggaggggcaggcagggccgggggcgtggtcaacgcgggccccgccccccgggctctacccccgagcgtacgcgcgcgcctgaagcagccaaccaggaagcgcagagcaggttcaaacacagacggcgggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggcagagatagtgttggaggctttctgtgcacacgccagccagcgcatcagccagctggaacaggacctagcatccatgcgggaattcagaggccttctgaaggatgcccagacccaactggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccgcagagaccccaggcatggaggagagcctggcagaaatgagtattatgactactgagcttcagagtctttgttccctgctacaagagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtggacaaactgagagtgatgttcctggagatgaaaaatgagaaggaaaaactcatgatcaagttccagagccatagaaatatcctagaggagaaccttcggcgctctgacaaggagttagaaaaactagatgacattgttcagcatatttataagaccctgctctctattccagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtatttaatgaa

SEQ ID NO: 185517 - DNA, 870 bp, Homo sapiens
  Payload ID: 16532
  Gene Symbol: SPAG5
  Gene Name: sperm associated antigen 5
  ENST ID: ENST00000536674
  CDS Start-End: 54-870
catggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcaggtgagattcgcctggacagcttctcgactgggctgtttgcccagggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatt

SEQ ID NO: 185518 - DNA, 904 bp, Homo sapiens
  Payload ID: 16532
  Gene Symbol: SPAG5
  Gene Name: sperm associated antigen 5
  ENST ID: ENST00000578479
  CDS Start-End: 60-278
ggtgaacatggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtggg

SEQ ID NO: 185519 - DNA, 715 bp, Homo sapiens
  Payload ID: 16532
  Gene Symbol: SPAG5
  Gene Name: sperm associated antigen 5
  ENST ID: ENST00000584206
  CDS Start-End: 1-715
tccctcacccagaaacccaggacagtagcacacagactgacacatctcacagtgggataactaataaacttcagcatcttaaggagagccatgagatgggacaggccctacagcaggccagaaatgtcatgcaatcatgggtgcttatctctaaagagctgatatccttgcttcacctatccctgttgcatttagaagaagataagactactgtgagtcaggagtctcggcgtgcagaaacattggtctgttgctgttttgatttgctgaagaaattgagggcaaagctccagagcctcaaagcagaaagggaggaggcaaggcacagagaggaaatggctctcagaggcaaggatgcggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggaggtttctagggtgctggaacaagtctctgcccagttagaggagtgcaaaggccaaacagaacaactggagttggaaaacagtcgtctagcaacagatctccgggctcagttgcagattctggccaacatggacagccagctaaaagagct

SEQ ID NO: 185520 - DNA, 335 bp, Homo sapiens
  Payload ID: 16532
  Gene Symbol: SPAG5
  Gene Name: sperm associated antigen 5
  ENST ID: ENST00000578230
  CDS Start-End: 1-174
caggagcaagatctggagaaaacacggcagtactctcaaaagctagggctgctgactgagcaactacagagcctgactctctttctacagacaaaactaaaggagaagactatgtttcaagaaagcagaaatatagccttctttggcctccctgcagtgtgcactaaacaataaatggttgacatcattcagaatacaaagactgaacaagagacccttctgctgagtacagcctgtcctcccacccaggaacaccctctgcctaatgacaggaccttcctgggaagcatcttgacagcagtggcagatgaagagccagaatcaactcctgtgcc

SEQ ID NO: 185521 - DNA, 899 bp, Homo sapiens
  Payload ID: 16532
  Gene Symbol: SPAG5
  Gene Name: sperm associated antigen 5
  ENST ID: ENST00000580567
  CDS Start-End: 52-273
tggcgtcctcgacttggtctgagacgtgataggcctgccttctggttgaagatgtggcgagtgaaaaaactgagcctcagcctgtcgccttcgccccagacgggaaaaccatctatgagaactcctctccgtgaacttaccctgcagcccggtgccctcaccaactctggaaaaagatcccccgcttgctcctcgctgaccccatcactgtgcaagctggggctgcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtggccggcctccagatctgactgccttgtctcgacatgacttggaagataacctgctgagctctcttgtcattctggaggttctctcccgccagcttcgggactggaagagccagctggctgtccctcacccagaaacccaggacagtagcacacagactgacacatctcacagtggg

SEQ ID NO: 185522 - DNA, 978 bp, Homo sapiens
  Payload ID: 16532
  Gene Symbol: SPAG5
  Gene Name: sperm associated antigen 5
  ENST ID: ENST00000580083
  CDS Start-End: 1-390
tctcggcgtgcagaaacattggtctgttgctgttttgatttgctgaagaaattgagggcaaagctccagagcctcaaagcagaaagggaggaggcaaggcacagagaggaaatggctctcagaggcaaggatgcggtagggcttcatgccaagcaagaagagctggttcagcagacagtgagtcttacttctaccttgcaacaagactggaggtccatgcaactggattatacaacatggacagctttgctgagtcggtcccgacaactcacagagaaactcacagtcaagagccagcaagccctgcaggaacgtgatgtggcaattgaggaaaagcaggagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagactgaacaagagacccttctgctgagtacagcctgtcctcccacccaggaacaccctctgcctaatgacaggaccttcctgggaagcatcttgacagcagtggcagatgaag

SEQ ID NO: 185523 - DNA, 755 bp, Homo sapiens
  Payload ID: 16532
  Gene Symbol: SPAG5
  Gene Name: sperm associated antigen 5
  ENST ID: ENST00000378976
  CDS Start-End: 1-559
tctagcaacagatctccgggctcagttgcagattctggccaacatggacagccagctaaaagagctacagagtcagcatacccattgtgcccaggacctggctatgaaggatgagttactctgccagcttacccagagcaatgaggagcaggctgctcaatggcaaaaggaagagatggcactaaaacacatgcaggcagaactgcagcagcaacaagctgtcctggccaaagaggtgcgggacctgaaagagaccttggagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacggctaaactggccagcaccatagcagataaccaggagcaagatctggagaaaacacggcagtactctcaaaagctagggctgctgactgagcaactacagagcctgactctctttctacagacaaaactaaaggagaagctattttttcttctttgcccttagactgaacaagagacccttctgctgagtacagcctgtcctcccacccaggaacaccctctgcctaatgacaggaccttcctgggaagcatcttgacagcagtggcagatgaagagccagaatcaactcctgtgcccttgcttggaagtgacaagagtgctttcacccgagtagcatcaatggtttcccttcagcccg

SEQ ID NO: 185524 - DNA, 719 bp, Homo sapiens
  Payload ID: 16532
  Gene Symbol: SPAG5
  Gene Name: sperm associated antigen 5
  ENST ID: ENST00000582076
  CDS Start-End: 1-556
agagtctaaagaagaagccatcaggactctgcagcgaaaaatttgtgagctgcaagctaggctgcaggcccaggaagaacagcatcaggaagtccagaaggcaaaagaagcagacatagagaagctgaaccaggccttgtgcttgcgctacaagaatgaaaaggagctccaggaagtgatacagcagcagaatgagaagatcctagaacagatagacaagagtggcgagctcataagccttagagaggaggtgacccaccttacccgctcacttcggcgtgcggagacagagaccaaagtgctccaggaggccctggcaggccagctggactccaactgccagcctatggccaccaattggatccaggagaaagtgtggctctctcaggaggtggacaaactgagagtgatgttcctggagatgaaaaatgagaaggaaaaactcatgatcaagttccagagccatagaaatatcctagaggagaaccttcggcgctctgacaaggagttagaaaaactagatgacattgttcagcatatttataagaggtggtgaggggatgcaaagaactacagggattgctggaatttctgagctaagaaactgaaagccagaatctgcttcacctctttttacctgcaatacccccttaccccaataccaagaccaactggcatagagccaactgagataaatgctatttaaataaagtgtattt

SEQ ID NO: 185525 - DNA, 2421 bp, Homo sapiens
  Payload ID: 16533
  Gene Symbol: SPAG6
  Gene Name: sperm associated antigen 6
  Uniprot ID: O75602
  ENST ID: ENST00000313311
  CDS Start-End: 116-1492
gagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagatatattgcaagacataatgcagaactgtcacaagctgtggtggatgcaggagctgttcctcttttagtactctgtatccaggagccagaaattgctttgaaaaggattgctgcttcggccctcagtgatattgcaaagcattctccagagttagcacagacagtagtggatgcaggagctgttgctcatttagcccagatgatcctgaaccctgatgctaaattgaagcatcagatcctttcagctctcagtcaggtttcaaaacattccgtggatctggcagaaatggttgttgaagcagagatttttccagttgtacttacctgtctgaaggacaaggatgaatacgtgaagaaaaatgcttctactttaattagagagattgcaaaacatacacccgagctttcacagctggtagttaacgcaggaggggttgctgccgtgattgactgcattgggtcctgcaaagggaacacacggctgcctggcatcatgatgcttggttatgtagcagctcattctgagaacctagcaatggcagtcatcatttctaagggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaacatgtggttggacagttcagtaaggtattattcccctggatattcagatacacttctgcagagggtggacagctatcaaccacttaataactgagcaaagttatattgtgatactcaaattcacagcagagtagttttgagtaacagtaattaaatccttctaaatatttgaactaagtatattctagatttatttaatgggaaatacctttagataatattttctaaatttatgtaatactttaaacattcgtagcttgaatatgtgaggaactattcatggtcattcgcatgcataggatttgttctacaggtagattttaaaaacacgttaaagggccttaaggcattttgttattctgttaaaaaccacacacactcgtacatgcagacacctccaatgagatatagttaagagatggcattcaaaaaccctaaattattctagccaatttgtcataggcataggcaaggaaagctggccttgctaactatatagtagtatacacaagagaaatctttgaaggaggaaactgatgacagatatacagggcacttgaaggagactctgatgctagttatataagtgcattaacttaagacacggactctgtgggtaacctgttaggttttactaagaatttaggaaaaatttactcctctttatcacaagttttccaaacctccttccccaccctatctaaagtgttccttacctttcatgggcccagcgagggtagaattcagaatagagagttatactcctgcatacatgctctccctctcattgaaaggtttcttagtctagctctgctcatgaatgaacaaagaagcaggcatgtaaaatggatccttgtcctaacgtcactttcccaagtttcaaaagtcacattttcaggtatttaaggaatagtttgaagctaataccatcaggctcagagtttacatgcatttttacttaggaagtggtaaacgggtgaaagagggtttcaataaaattttaaataaaaacagca

SEQ ID NO: 185526 - DNA, 2770 bp, Homo sapiens
  Payload ID: 16533
  Gene Symbol: SPAG6
  Gene Name: sperm associated antigen 6
  ENST ID: ENST00000376603
  CDS Start-End: 320-1774
aagacggccgcgttccggttccggtaggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaaggtagggccgaggcgggcaggtgccctaactagctggcgccgaggagacccgggtgcggtgggctccaccgactctctctcccgcagtgttcgagcaataccagaaggccaggacccagttcgtgcagatggtggcggagctggcgactagaccccaaaacatcgagacgctgcagaacgcgggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagatatattgcaagacataatgcagaactgtcacaagctgtggtggatgcaggagctgttcctcttttagtactctgtatccaggagccagaaattgctttgaaaaggattgctgcttcggccctcagtgatattgcaaagcattctccagagttagcacagacagtagtggatgcaggagctgttgctcatttagcccagatgatcctgaaccctgatgctaaattgaagcatcagatcctttcagctctcagtcaggtttcaaaacattccgtggatctggcagaaatggttgttgaagcagagatttttccagttgtacttacctgtctgaaggacaaggatgaatacgtgaagaaaaatgcttctactttaattagagagattgcaaaacatacacccgagctttcacagctggtagttaacgcaggaggggttgctgccgtgattgactgcattgggtcctgcaaagggaacacacggctgcctggcatcatgatgcttggttatgtagcagctcattctgagaacctagcaatggcagtcatcatttctaagggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaacatgtggttggacagttcagtaaggtgctgccgcatgatagcaaagctcgacgactttttgtaacaagtggtggccttaaaaaagttcaagagataaaagcagaacctggttctctccttcaagaatacatcaacagtattaacagttgttaccccgaggaaatagtgagtaaattctttccagagttgcaagtttgtgcactttttaggaagtttatgagaactccttgaccaaaagagttccaataggtattattcccctggatattcagatacacttctgcagagggtggacagctatcaaccacttaataactgagcaaagttatattgtgatactcaaattcacagcagagtagttttgagtaacagtaattaaatccttctaaatatttgaactaagtatattctagatttatttaatgggaaatacctttagataatattttctaaatttatgtaatactttaaacattcgtagcttgaatatgtgaggaactattcatggtcattcgcatgcataggatttgttctacaggtagattttaaaaacacgttaaagggccttaaggcattttgttattctgttaaaaaccacacacactcgtacatgcagacacctccaatgagatatagttaagagatggcattcaaaaaccctaaattattctagccaatttgtcataggcataggcaaggaaagctggccttgctaactatatagtagtatacacaagagaaatctttgaaggaggaaactgatgacagatatacagggcacttgaaggagactctgatgctagttatataagtgcattaacttaagacacggactctgtgggtaacctgttaggttttactaagaatttaggaaaaatttactcctctttatcacaagttttccaaacctccttccccaccctatctaaagtgttccttacctttcatgggcccagcgagggtagaattcagaatagagagttatactcctgcatacatgctctccctctcattgaaaggtttcttagtctagctctgctcatgaatgaacaaagaagcaggcatgtaaaatggatccttgtcctaacgtcactttcccaagtttcaaaagtcacattttcaggtatttaaggaatagtttgaagctaataccatcaggctcagagtttacatgcatttttacttaggaagtggtaaacgggtgaaagagggtttcaataaaatttt

SEQ ID NO: 185527 - DNA, 2605 bp, Homo sapiens
  Payload ID: 16533
  Gene Symbol: SPAG6
  Gene Name: sperm associated antigen 6
  Uniprot ID: O75602
  ENST ID: ENST00000376624
  CDS Start-End: 143-1672
aggttgcccgggagacgcgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagatatattgcaagacataatgcagaactgtcacaagctgtggtggatgcaggagctgttcctcttttagtactctgtatccaggagccagaaattgctttgaaaaggattgctgcttcggccctcagtgatattgcaaagcattctccagagttagcacagacagtagtggatgcaggagctgttgctcatttagcccagatgatcctgaaccctgatgctaaattgaagcatcagatcctttcagctctcagtcaggtttcaaaacattccgtggatctggcagaaatggttgttgaagcagagatttttccagttgtacttacctgtctgaaggacaaggatgaatacgtgaagaaaaatgcttctactttaattagagagattgcaaaacatacacccgagctttcacagctggtagttaacgcaggaggggttgctgccgtgattgactgcattgggtcctgcaaagggaacacacggctgcctggcatcatgatgcttggttatgtagcagctcattctgagaacctagcaatggcagtcatcatttctaagggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaacatgtggttggacagttcagtaaggtgctgccgcatgatagcaaagctcgacgactttttgtaacaagtggtggccttaaaaaagttcaagagataaaagcagaacctggttctctccttcaagaatacatcaacagtattaacagttgttaccccgaggaaatagtgaggtattattcccctggatattcagatacacttctgcagagggtggacagctatcaaccacttaataactgagcaaagttatattgtgatactcaaattcacagcagagtagttttgagtaacagtaattaaatccttctaaatatttgaactaagtatattctagatttatttaatgggaaatacctttagataatattttctaaatttatgtaatactttaaacattcgtagcttgaatatgtgaggaactattcatggtcattcgcatgcataggatttgttctacaggtagattttaaaaacacgttaaagggccttaaggcattttgttattctgttaaaaaccacacacactcgtacatgcagacacctccaatgagatatagttaagagatggcattcaaaaaccctaaattattctagccaatttgtcataggcataggcaaggaaagctggccttgctaactatatagtagtatacacaagagaaatctttgaaggaggaaactgatgacagatatacagggcacttgaaggagactctgatgctagttatataagtgcattaacttaagacacggactctgtgggtaacctgttaggttttactaagaatttaggaaaaatttactcctctttatcacaagttttccaaacctccttccccaccctatctaaagtgttccttacctttcatgggcccagcgagggtagaattcagaatagagagttatactcctgcatacatgctctccctctcattgaaaggtttcttagtctagctctgctcatgaatgaacaaagaagcaggcatgtaaaatggatccttgtcctaacgtcactttcccaagtttcaaaagtcacattttcaggtatttaaggaatagtttgaagctaataccatcaggctcagagtttacatgcatttttacttaggaagtggtaaacgggtgaaagagggtttcaataaaattttaaataaaaacagcattagaattgtc

SEQ ID NO: 185528 - DNA, 853 bp, Homo sapiens
  Payload ID: 16533
  Gene Symbol: SPAG6
  Gene Name: sperm associated antigen 6
  ENST ID: ENST00000435326
  CDS Start-End: 115-853
agaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgagcccggagcccgaacccccgtcgccccccgcgcactgagtccccgacgcctccgccccgctgccctgcccgtggagctcttggggagccgcagtgtggggaccggagttcgcaaaagcatccattcttttcagcgggtctttgggggtcaggccgagagggtgaagcttccagatggttgtgggaggtgcgcgttgtccctgtttccatcttcattgcacacaggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagatatattgcaagacataatgcagaactgtcacaagctgtggtggatgcaggagctgttcctc

SEQ ID NO: 185529 - DNA, 700 bp, Homo sapiens
  Payload ID: 16533
  Gene Symbol: SPAG6
  Gene Name: sperm associated antigen 6
  ENST ID: ENST00000456231
  CDS Start-End: 126-700
cgggtacacagagaagcggctcccgtcggaggccgagtcgtcgccacgatcgcccccttggtggactcgcaggccgagcggcttccccgcagagctcgaggagggcagacggcggcgggggcgccatgagtcagaggcaggtgctgcaagtgttcgagcaataccagaaggccaggacccagttcgtgcagatggtggcggagctggcgactagaccccaaaacatcgagacgctgcagaacgcgggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaaca

SEQ ID NO: 185530 - DNA, 2376 bp, Homo sapiens
  Payload ID: 16533
  Gene Symbol: SPAG6
  Gene Name: sperm associated antigen 6
  Uniprot ID: O75602
  ENST ID: ENST00000538630
  CDS Start-End: 1-1455
atgcattcactcaccatggatctctggatacctaatggacaggcaggtgtaatgtctttgctgagaactcttcttctggacgtggtcccaacaattcaacagactgctgctttggctcttgggagactggccaattataatgatgacctagcagaagctgttgtgaagtgcgacattcttccacagcttgtttattcattggcagaacagaatcgcttctacaagaaagcagctgcctttgtgttacgagcagttggtaaacattctccccagctagctcaggcaatagtcgattgtggagcactggatacgctggtcatatgcttggaagattttgaccctggagtcaaggaggctgcagcctgggcacttagatatattgcaagacataatgcagaactgtcacaagctgtggtggatgcaggagctgttcctcttttagtactctgtatccaggagccagaaattgctttgaaaaggattgctgcttcggccctcagtgatattgcaaagcattctccagagttagcacagacagtagtggatgcaggagctgttgctcatttagcccagatgatcctgaaccctgatgctaaattgaagcatcagatcctttcagctctcagtcaggtttcaaaacattccgtggatctggcagaaatggttgttgaagcagagatttttccagttgtacttacctgtctgaaggacaaggatgaatacgtgaagaaaaatgcttctactttaattagagagattgcaaaacatacacccgagctttcacagctggtagttaacgcaggaggggttgctgccgtgattgactgcattgggtcctgcaaagggaacacacggctgcctggcatcatgatgcttggttatgtagcagctcattctgagaacctagcaatggcagtcatcatttctaagggtgtaccccagttgtcagtctgcttgtcagaagaaccggaagatcatattaaggctgcagctgcttgggccttaggacagattggaagacacactcctgaacacgcacgggctgttgcagtcacaaatactttgccagttctgctttctttgtacatgtcaacagaaagttctgaggatctccaagtaaaaagtaaaaaagccataaagaatatcctgcaaaaatgtacctacttaccagcccttgaaccatttctatatgatgctcctcccaatattctgaaacatgtggttggacagttcagtaaggtgctgccgcatgatagcaaagctcgacgactttttgtaacaagtggtggccttaaaaaagttcaagagataaaagcagaacctggttctctccttcaagaatacatcaacagtattaacagttgttaccccgaggaaatagtgaggtattattcccctggatattcagatacacttctgcagagggtggacagctatcaaccacttaataactgagcaaagttatattgtgatactcaaattcacagcagagtagttttgagtaacagtaattaaatccttctaaatatttgaactaagtatattctagatttatttaatgggaaatacctttagataatattttctaaatttatgtaatactttaaacattcgtagcttgaatatgtgaggaactattcatggtcattcgcatgcataggatttgttctacaggtagattttaaaaacacgttaaagggccttaaggcattttgttattctgttaaaaaccacacacactcgtacatgcagacacctccaatgagatatagttaagagatggcattcaaaaaccctaaattattctagccaatttgtcataggcataggcaaggaaagctggccttgctaactatatagtagtatacacaagagaaatctttgaaggaggaaactgatgacagatatacagggcacttgaaggagactctgatgctagttatataagtgcattaacttaagacacggactctgtgggtaacctgttaggttttactaagaatttaggaaaaatttactcctctttatcacaagttttccaaacctccttccccaccctatctaaagtgttccttacctttcatgggcccagcgagggtagaattcagaatagagagttatactcctgcatacatgctctccctctcattgaaaggtttcttagtctagctctgctcatgaatgaacaaagaagcaggcatgtaaaatggatccttgtcctaacgtcactttcccaagtttcaaaagtcacattttcaggtatttaaggaatagtttgaagctaataccatcaggctcagagtttacatgcatttttacttaggaagtggtaaacgggtgaaagagggtttcaataaaattttaaataaaaacagc

SEQ ID NO: 185531 - DNA, 1058 bp, Homo sapiens
  Payload ID: 16534
  Gene Symbol: SPAG7
  Gene Name: sperm associated antigen 7
  Uniprot ID: O75391
  ENST ID: ENST00000206020
  CDS Start-End: 69-752
gtttccggccttaaaggcattccgcccttccctttaagacgcaccgccccctctcagtcactcccaagatggcggacctactgggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaaccc

SEQ ID NO: 185532 - DNA, 694 bp, Homo sapiens
  Payload ID: 16534
  Gene Symbol: SPAG7
  Gene Name: sperm associated antigen 7
  ENST ID: ENST00000575784
  CDS Start-End: 19-282
ggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactccttatcccccctccccgaccaaggaatgaaatgaaacatttgtatggactctgaccccatcattctgctcttcttcaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggg

SEQ ID NO: 185533 - DNA, 1668 bp, Homo sapiens
  Payload ID: 16534
  Gene Symbol: SPAG7
  Gene Name: sperm associated antigen 7
  ENST ID: ENST00000573366
  CDS Start-End: 860-1390
tctgcctccctccgacaacctttttcccatccgtagccttaaattcccgagctgcccgggcggatcgtagtgttgattggagggatgagaatacccgccgggtccgattggccactgtctccgcctgcgttctcggagtagcttccctgcgggtgggctggagttcggcggccggcgtagggcgcggccctgcagggcggtgggagcctccccggggctgctcgtgttgcagcttgggatgatactggcggaacgcaggaccccaactcccaaacctgcggaccttgaccacggacgagccctgtcccagctccccacgtgccccagggggaccagagcaggcaggacgccttccaagtattcaagggccgctggttgcctacgcttcgtccccttgtttcttgaacaaccgttagggaccaggggtacccctcagggaggccacagtccggggctggggcgctcattgatgcagtgatcacacgtaagtttaataaccaacttgataagtgctctgagagaaaaataactgtgagagcggccacctgaggttctcccccaatctgcagtgagccgagatcagaacaggtaattccgtaaatgagagagagaagcaaagcgttacaggcagaagagtctatttgaaatctctgagaaaggaggaagcatgatgggaatggggaactggaattctctaatgctccgatgactgtctaagtgggggatcacccggcattgacagactgggaagcttaaatgagtcactcgcctgaggtcacatggttagtttgaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtgtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtac

SEQ ID NO: 185534 - DNA, 1094 bp, Homo sapiens
  Payload ID: 16534
  Gene Symbol: SPAG7
  Gene Name: sperm associated antigen 7
  ENST ID: ENST00000575142
  CDS Start-End: 20-604
gggctccatcctgagctccatggagaagccacccagcctcggtgaccaggagactcggcgcaaggcccgagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaagctgaaggagctggcccagaggcaagaggaggaggcagcccagcaggggcctgtggtggtgagccctgccagcgactacaaggacaagtacagccacctcatcggcaagggagcagccaaagacgcagcccacatgctacaggccaataagacctacggctgtggtgaggccacagtgcggctgggggtggctgggagaggagcataggatgcggcaggagggcagtggaggctgaggtacggatttctaggcccgccctaccctcctctctgcccctagtgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttccccatggggctggggtactttacattcaataaatactgtttaacccaa

SEQ ID NO: 185535 - DNA, 1759 bp, Homo sapiens
  Payload ID: 16535
  Gene Symbol: SPAG8
  Gene Name: sperm associated antigen 8
  Uniprot ID: Q99932
  ENST ID: ENST00000340291
  CDS Start-End: 126-1631
gaagacttccgccccgcagaggacttgcctccaccgccacctgcaagtccgcccagctgtacttctgcgcaggctccaggagttgtttgctgtctctatggcaacccagtagctggagtctgaagatggagaccaacgagtctacggagggatcgcggtcgcggtcgcgatctttagacatacagcccagctccgaaggactggggcccacttcggaaccgtttccttcttcagatgacagtcccaggtcggccctggcagctgcaaccgcagcagctgcagcggctgcatcagctgctgcagctactgcagccttcaccactgccaaagcagctgcattatctacaaagaccccagcgccctgttctgagttcatggagccgtcctctgaccccagccttcttggggagccctgtgcgggacccggctttacccacaatatagcccatgggagtcttggctttgagcccgtctatgtttcctgtattgctcaggacacttgcactacaactgaccatagttctaatcctggccctgttccaggctctagctctgggcctgttcttggttccagctcaggtgctggccatggctctggctctggctctggtcctggctgtggctctgtccctggctctggctctggtcctggtcctggctctggtcctggctctggtcctggtcatggctctggctctcatcctggtcctgcctctgggcctggtccagacactggccctgactctgagctcagcccctgtattcctccagggttcagaaacctggtggcagatcgggtccctaactatacctcctggagtcagcactgcccctgggagccccagaaacaaccaccttgggaatttttgcaagtcttagaaccgggtgcccgaggactatggaaacccccagacattaaagggaagcttatggtttgctatgaaactttgccgcggggccagtgcctcctctacaactgggaggaagagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctgtaaagaggtgcaggcagaacaggaacccacaaggaagctcttcgaggttgagtctgtgacacaccatgactaccgaatggagctggcacaagcagggactcctgccccaacaaagcctcacgactaccgccaggagcaacctgagaccttctggatacagagggcaccacagctgccgacatggtggccattgcccacccaggtaccagcagcagaagactatctgacttggaaagaatgggggtttacaggagtccaggaggtcctttccgctctcctaagagccacacctggtgaatactcagtaaacatttgcggaatgaatgaacaccctgtctgcagcaggacatggacaaataggctctgccatcaggaaatgggaagcaagaaaacggtaactcaagaggacagaggctggtgaggaggtaaagcaggcccagtgaaatggacctgacagcccaaactgtcagagaggaggaaagcaggcatttgattttggtaattgtgccaaagctatgtaagagaataaatgccattgttttaaggaaa

SEQ ID NO: 185536 - DNA, 1600 bp, Homo sapiens
  Payload ID: 16535
  Gene Symbol: SPAG8
  Gene Name: sperm associated antigen 8
  Uniprot ID: Q99932
  ENST ID: ENST00000396638
  CDS Start-End: 24-1481
aacccagtagctggagtctgaagatggagaccaacgagtctacggagggatcgcggtcgcggtcgcgatctttagacatacagcccagctccgaaggactggggcccacttcggaaccgtttccttcttcagatgacagtcccaggtcggccctggcagctgcaaccgcagcagctgcagcggctgcatcagctgctgcagctactgcagccttcaccactgccaaagcagctgcattatctacaaagaccccagcgccctgttctgagttcatggagccgtcctctgaccccagccttcttggggagccctgtgcgggacccggctttacccacaatatagcccatgggagtcttggctttgagcccgtctatgtttcctgtattgctcaggacacttgcactacaactgaccatagttctaatcctggccctgttccaggctctagctctgggcctgttcttggttccagctcaggtgctggccatggctctggctctggctctggtcctggctgtggctctgtccctggctctggctctggtcctggtcctggctctggtcctggctctggtcctggtcatggctctggctctcatcctggtcctgcctctgggcctggtccagacactggccctgactctgagctcagcccctgtattcctccagggttcagaaacctggtggcagatcgggtccctaactatacctcctggagtcagcactgcccctgggagccccagaaacaaccaccttgggaatttttgcaagtcttagaaccgggtgcccgaggactatggaaacccccagacattaaagggaagcttatggtttgctatgaaactttgccgcggggccagtgcctcctctacaactgggaggaagagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctgtaaagaggtgcaggcagaacaggaacccacaaggaagctcttcgaggttgagtctgtgacacaccatgactaccgaatggagctggcacaagcagggactcctgccccaacaaagcctcacgactaccgccaggagcaacctgagaccttctggatacagagggcaccacagctgccgggtgtcagtaacatcaggacattggacacaccattccggaagaactgcagcttctcaacaccagtacccttgtctctggggaaacttttgccctatgaacctgagaattacccctaccaattgggagaaatatcttcccttccctgtcccggaggaaggctgggtggtggaggggggagaatgactcctttctgaggggtgaggagggaagtggggtatggaatatggaatctatttctgtctgcactagagaggtcgggaggaagttaattctcactgtacttgaagaggctttacataaagggttctctctc

SEQ ID NO: 185537 - DNA, 1553 bp, Homo sapiens
  Payload ID: 16535
  Gene Symbol: SPAG8
  Gene Name: sperm associated antigen 8
  ENST ID: ENST00000497810
  CDS Start-End: 1-1451
tggagaccaacgagtctacggagggatcgcggtcgcgatctttagacatacagcccagctccgaaggactggggcccacttcggaaccgtttccttcttcagatgacagtcccaggtcggccctggcagctgcaaccgcagcagctgcagcggctgcatcagctgctgcagctactgcagccttcaccactgccaaagcagctgcattatctacaaagaccccagcgccctgttctgagttcatggagccgtcctctgaccccagccttcttggggagccctgtgcgggacccggctttacccacaatatagcccatgggagtcttggctttgagcccgtctatgtttcctgtattgctcaggacacttgcactacaactgaccatagttctaatcctggccctgttccaggctctagctctgggcctgttcttggttccagctcaggtgctggccatggctctggctctggctctggtcctggctgtggctctgtccctggctctggctctggtcctggtcctggctctggtcctggctctggtcctggtcatggctctggctctcatcctggtcctgcctctgggcctggtccagacactggccctgactctgagctcagcccctgtattcctccagggttcagaaacctggtggcagatcgggtccctaactatacctcctggagtcagcactgcccctgggagccccagaaacaaccaccttgggaatttttgcaagtcttagaaccgggtgcccgaggactatggaaacccccagacattaaagggaagcttatggtttgctatgaaactttgccgcggggccagtgcctcctctacaactgggaggaagagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctgtaaagaggtgcaggcagaacaggaacccacaaggaagctcttcgaggttgagtctgtgacacaccatgactaccgaatggagctggcacaagcagggactcctgccccaacaaagcctcacgactaccgccaggagcaacctgagaccttctggatacagagggcaccacagctgccgggtgtcagtaacatcaggacattggacacaccattccggaagaactgcagcttctcaacaccagtacccttgtctctggggaaacttttgccctatgaacctgagaattacccctaccaattgggagaaatatcttcccttccctgtcccggaggaaggctgggtggtggaggggggagaatgactcctttctgaggggtgaggagggaagtggggtatggaatatggaatctatttctgtctgcactagagaggtcgggaggaagttaattctcactgtacttgaagaggctttac

SEQ ID NO: 185538 - DNA, 1618 bp, Homo sapiens
  Payload ID: 16535
  Gene Symbol: SPAG8
  Gene Name: sperm associated antigen 8
  ENST ID: ENST00000484764
  CDS Start-End: 42-1475
gtttgctgtctctatggcaacccagtagctggagtctgaagatggagaccaacgagtctacggagggatcgcggtcgcgatctttagacatacagcccagctccgaaggactggggcccacttcggaaccgtttccttcttcagatgacagtcccaggtcggccctggcagctgcaaccgcagcagctgcagcggctgcatcagctgctgcagctactgcagccttcaccactgccaaagcagctgcattatctacaaagaccccagcgccctgttctgagttcatggagccgtcctctgaccccagccttcttggggagccctgtgcgggacccggctttacccacaatatagcccatgggagtcttggctttgagcccgtctatgtttcctgtattgctcaggacacttgcactacaactgaccatagttctaatcctggccctgttccaggctctagctctgggcctgttcttggttccagctcaggtgctggccatggctctggctctggctctggtcctggctgtggctctgtccctggctctggctctggtcctggtcctggctctggtcctggctctggtcctggtcatggctctggctctcatcctggtcctgcctctgggcctggtccagacactggccctgactctgagctcagcccctgtattcctccagggttcagaaacctggtggcagatcgggtccctaactatacctcctggagtcagcactgcccctgggagccccagaaacaaccaccttgggaatttttgcaagtcttagaaccgggtgcccgaggactatggaaacccccagacattaaagggaagcttatggtttgctatgaaactttgccgcggggccagtgcctcctctacaactgggaggaagagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctgtaaagaggtgcaggcagaacaggaacccacaaggaagctcttcgaggttgagtctgtgacacaccatgactaccgaatggagctggcacaagcagggactcctgccccaacaaaggagcaacctgagaccttctggatacagagggcaccacagctgccgggtgtcagtaacatcaggacattggacacaccattccggaagaactgcagcttctcaacaccagtacccttgtctctggggaaacttttgccctatgaacctgagaattacccctaccaattgggagaaatatcttcccttccctgtcccggaggaaggctgggtggtggaggggggagaatgactcctttctgaggggtgaggagggaagtggggtatggaatatggaatctatttctgtctgcactagagaggtcgggaggaagttaattctcactgtacttgaagaggctttacataaagggttctctctcatcccaagactgctaatttagtga

SEQ ID NO: 185539 - DNA, 941 bp, Homo sapiens
  Payload ID: 16535
  Gene Symbol: SPAG8
  Gene Name: sperm associated antigen 8
  ENST ID: ENST00000472605
  CDS Start-End: 3-293
agatggagaccaacgagtctacggagggatcgcggtcgcggtcgcgatctttagacatacagcccagctccgaaggactggggcccacttcggaaccgtttccttcttcagatgacagtcccaggtcggccctggcagctgcaaccgcagcagctgcagcggctgcatcagctgctgcagctactgcagccttcaccactgccaaagcagctgcattatctacaaagaccccagcgccctgttctgagttcatggagccgtcctctgaccccagccttcttggggagccctagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctggtaagggattgggtaaaggggaagagggatggggaggagaaaaattgggtgagaatggccttgacacccctcgggctacatagtaaagaggtgcaggcagaacaggaacccacaaggaagctcttcgaggttgagtctgtgacacaccatgactaccgaatggagctggcacaagcagggactcctgccccaacaaaggtgagaacccaccccccatcccccgccacttgcaccagctgggctctgacaggctgtggccaagtaccaagcccagaggttgagagagagggctgaaggccaggagttactcagtaccctccctcacagcctcacgactaccgccaggagcaacctgagaccttctggatacagagggcaccacagctgccggtgtgtgagggtgactaggtgttgggggcagagcggggc

SEQ ID NO: 185540 - DNA, 2481 bp, Homo sapiens
  Payload ID: 16535
  Gene Symbol: SPAG8
  Gene Name: sperm associated antigen 8
  Uniprot ID: Q99932
  ENST ID: ENST00000475644
  CDS Start-End: 116-1396
gccccgcagaggacttgcctccaccgccacctgcaagtccgcccagctgtacttctgcgcaggctccaggagttgtttgctgtctctatggcaacccagtagctggagtctgaagatggagaccaacgagtctacggagggatcgcggtcgcggtcgcgatctttagacatacagcccagctccgaaggactggggcccacttcggaaccgtttccttcttcagatgacagtcccaggtcggccctggcagctgcaaccgcagcagctgcagcggctgcatcagctgctgcagctactgcagccttcaccactgccaaagcagctgcattatctacaaagaccccagcgccctgttctgagttcatggagccgtcctctgaccccagccttcttggggagccctgtgcgggacccggctttacccacaatatagcccatgggagtcttggctttgagcccgtctatgtttcctgtattgctcaggacacttgcactacaactgaccatagttctaatcctggccctgttccaggctctagctctgggcctgttcttggttccagctcaggtgctggccatggctctggctctggctctggtcctggctgtggctctgtccctggctctggctctggtcctggtcctggctctggtcctggctctggtcctggtcatggctctggctctcatcctggtcctgcctctgggcctggtccagacactggccctgactctgagctcagcccctgtattcctccagggttcagaaacctggtggcagatcgggtccctaactatacctcctggagtcagcactgcccctgggagccccagaaacaaccaccttgggaatttttgcaagtcttagaaccgggtgcccgaggactatggaaacccccagacattaaagggaagcttatggtttgctatgaaactttgccgcggggccagtgcctcctctacaactgggaggaagagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctgtaaagaggtgcaggcagaacaggaacccacaaggaagctcttcgaggttgagtctgtgacacaccatgactaccgaatggagctggcacaagcagggactcctgccccaacaaagcctcacgactaccgccaggagcaacctgagaccttctggatacagagggcaccacagctgccggtgtgtgagggtgactaggtgttgggggcagagcggggcaggaaaggtagggcagagttgttttgttctggcttggggagagtgggatccatcctcatcctggcactcctccagggtgtcagtaacatcaggacattggacacaccattccggaagaactgcagcttctcaacaccagtacccttgtctctggggaaacttttgccctatgaacctgagaattacccctaccaattgggagaaatatcttcccttccctgtcccggaggaaggctgggtggtggaggggggagaatgactcctttctgaggggtgaggagggaagtggggtatggaatatggaatctatttctgtctgcactagagaggtcgggaggaagttaattctcactgtacttgaagaggctttacataaagggttctctctcatcccaagactgctaatttagtgattctgtgagtcactgtgtgcataccccataacctttccttgggattgcccctatcccacactatgacatcagaactttttttattattgttttatatttgaccaaaatattctggtttagatacagatatttacagaaagtagggaggaaggggaccaagccagagagggacaggtatatgtacagggctgagctgcagagggctacaacttccatataaggtaggtttttttgtggctgttttccattgcatatgaaaatgtccatttctggtgtgtgcagacatggtggccattgcccacccaggtaccagcagcagaagactatctgacttggaaagaatgggggtttacaggagtccaggaggtcctttccgctctcctaagagccacacctggtgaatactcagtaaacatttgcggaatgaatgaacaccctgtctgcagcaggacatggacaaataggctctgccatcaggaaatgggaagcaagaaaacggtaactcaagaggacagaggctggtgaggaggtaaagcaggcccagtgaaatggacctgacagcccaaactgtcagagaggaggaaagcaggcatttgattttggtaattgtgccaaagctatgtaagagaataaatgccattgttttaagga

SEQ ID NO: 185541 - DNA, 752 bp, Homo sapiens
  Payload ID: 16535
  Gene Symbol: SPAG8
  Gene Name: sperm associated antigen 8
  ENST ID: ENST00000471631
  CDS Start-End: 29-238
atggcaacccagtagctggagtctgaagatggagaccaacgagtctacggagggatcgcggtcgcggtcgcgatctttagacatacagcccagctccgaaggactggggcccacttcggaaccgtttccttcttcagatgacagtcccagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctggtaagggattgggtaaaggggaagagggatggggaggagaaaaattgggtgagaatggccttgacacccctcgggctacatagtaaagaggtgcaggcagaacaggaacccacaaggaagctcttcgaggttgagtctgtgacacaccatgactaccgaatggagctggcacaagcagggactcctgccccaacaaaggtgagaacccaccccccatcccccgccacttgcaccagctgggctctgacaggctgtggccaagtaccaagcccagaggttgagagagagggctgaaggccaggagttactcagtaccctccctcacagcctcacgactaccgccaggagcaacctgagaccttctggatacagagggcacca

SEQ ID NO: 185542 - DNA, 759 bp, Homo sapiens
  Payload ID: 16535
  Gene Symbol: SPAG8
  Gene Name: sperm associated antigen 8
  ENST ID: ENST00000495667
  CDS Start-End: 27-236
ggcaacccagtagctggagtctgaagatggagaccaacgagtctacggagggatcgcggtcgcggtcgcgatctttagacatacagcccagctccgaaggactggggcccacttcggaaccgtttccttcttcagatgacagtcccagagagccaccaaccacctggatcaagtcccaagcatgcaggatggctctgagagttttttcttccgacacggacaccggggactgctgactatgcaactaaagtcacccatgccctccagcaccacccagaaagactcgtaccagccaccaggaaacgtctattggccacttcgagggaagcgtgaagccatgctggagatgctcctgcagcatcagatctggtaagggattgggtaaaggggaagagggatggggaggagaaaaattgggtgagaatggccttgacacccctcgggctacatagtaaagaggtgcaggcagaacaggaacccacaaggaagctcttcgaggttgagtctgtgacacaccatgactaccgaatggagctggcacaagcagggactcctgccccaacaaagcctcacgactaccgccaggagcaacctgagaccttctggatacagagggcaccacagctgccgggtgtcagtaacatcaggacattggacacaccattccggaagaactgcagcttctcaacaccagtacccttgtctctggggaaacttttgccctatgaacctgagaattacccctaccaattgggagaa

SEQ ID NO: 185543 - DNA, 8273 bp, Homo sapiens
  Payload ID: 16536
  Gene Symbol: SPAG9
  Gene Name: sperm associated antigen 9
  Uniprot ID: O60271
  ENST ID: ENST00000262013
  CDS Start-End: 210-4175
agttggtgcagcggcggttggggtgagagcgcctacgccacccctcccctcctccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggtcagcaatagtcctgaacctcagaaggctgtagaacaggaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaacaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccaacactttaggaggctgaggcagatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcaccacattggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 185544 - DNA, 4761 bp, Homo sapiens
  Payload ID: 16536
  Gene Symbol: SPAG9
  Gene Name: sperm associated antigen 9
  Uniprot ID: O60271
  ENST ID: ENST00000357122
  CDS Start-End: 210-4133
agttggtgcagcggcggttggggtgagagcgcctacgccacccctcccctcctccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaacaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataa

SEQ ID NO: 185545 - DNA, 4949 bp, Homo sapiens
  Payload ID: 16536
  Gene Symbol: SPAG9
  Gene Name: sperm associated antigen 9
  Uniprot ID: O60271
  ENST ID: ENST00000510283
  CDS Start-End: 219-3752
gcataaatgctaggagcagcagctctatggttatgaggtggggagaacggaatgacgtcatcgcttgggagctgctgcaggatggagtggaaagctgctgctgatggcattgtttttgtggcagcaagctgaatgacagatcctcactacaaagatacccctttggcccccgtgtaggcctccttggttcgggtgtttcaccatgccagcacagcgccatgagtcctggatgcatgctgctgtttgtgtttggctttgttggcggggcggtggtcattaattctgctatcttagtatctctctctgttttgctgcttgtgcacttttctatttctaccggtgtgccagctctgacgcagaacctaccaaggatactcagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaaccgtaatcctccaccagggacgtttactggggctgagggcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccatt

SEQ ID NO: 185546 - DNA, 822 bp, Homo sapiens
  Payload ID: 16536
  Gene Symbol: SPAG9
  Gene Name: sperm associated antigen 9
  ENST ID: ENST00000513746
  CDS Start-End: 1-459
acaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaacaaataaaacctcaggtgtaccaggaaatcgtcctggaagtgtaatccgtgtatatggtgatgaaaacagtgataaag

SEQ ID NO: 185547 - DNA, 686 bp, Homo sapiens
  Payload ID: 16536
  Gene Symbol: SPAG9
  Gene Name: sperm associated antigen 9
  ENST ID: ENST00000510855
  CDS Start-End: 219-686
gcataaatgctaggagcagcagctctatggttatgaggtggggagaacggaatgacgtcatcgcttgggagctgctgcaggatggagtggaaagctgctgctgatggcattgtttttgtggcagcaagctgaatgacagatcctcactacaaagatacccctttggcccccgtgtaggcctccttggttcgggtgtttcaccatgccagcacagcgccatgagtcctggatgcatgctgctgtttgtgtttggctttgttggcggggcggtggtcattaattctgctatcttagtatctctctctgttttgctgcttgtgcacttttctatttctaccggtgtgccagctctgacgcagaacctaccaaggatactcagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggtcagcaatagtcctgaacctcagaaggctgtagaacaggaggatgagctttctgatgttagccaaggcggatctaaagctaccactccagcatcaacagctaattcagatgtggcaacaattcctactgatactcccttaaaggaagaaaacgaa

SEQ ID NO: 185548 - DNA, 4659 bp, Homo sapiens
  Payload ID: 16536
  Gene Symbol: SPAG9
  Gene Name: sperm associated antigen 9
  Uniprot ID: O60271
  ENST ID: ENST00000505279
  CDS Start-End: 79-4014
gtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagtttgtgccaactcgtttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaacaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctga

SEQ ID NO: 185549 - DNA, 522 bp, Homo sapiens
  Payload ID: 16536
  Gene Symbol: SPAG9
  Gene Name: sperm associated antigen 9
  ENST ID: ENST00000511795
  CDS Start-End: 1-522
ggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggggaatattctgaccataatttctttggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatatt

SEQ ID NO: 185550 - DNA, 750 bp, Homo sapiens
  Payload ID: 16536
  Gene Symbol: SPAG9
  Gene Name: sperm associated antigen 9
  ENST ID: ENST00000513906
  CDS Start-End: 1-750
aggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattg

SEQ ID NO: 185551 - DNA, 8246 bp, Homo sapiens
  Payload ID: 16536
  Gene Symbol: SPAG9
  Gene Name: sperm associated antigen 9
  ENST ID: ENST00000618113
  CDS Start-End: 210-4148
agttggtgcagcggcggttggggtgagagcgcctacgccacccctcccctcctccggccccggcccccaccccgccgggcccagccccagccccggcccgggctccagccctagtacccgtcccagcccgagtcgggtccgtcccgtgcgggcaggtgccgcccctctgccggcgacgccccgggccgcccgcccgtccgcttgccaccatggagctggaggacggtgtggtgtatcaggaggagcccggcggctccggggccgtgatgtcggagcgggtgtccggcctggccggctccatctaccgcgagttcgagcggcttatcgggcgctatgacgaggaggtggtcaaagagctgatgccgctggtggtggctgtgctggagaacctggactcggtgttcgcgcaggaccaggagcaccaggtggagctggagctgctgcgggacgacaacgagcagctcatcacccagtacgagcgggagaaggcgctgcgcaagcacgctgaggagaaattcattgaatttgaagactctcaagaacaggaaaaaaaggacttacagacccgagtggaatctttagaatctcaaacaagacaacttgagctgaaagcgaaaaactatgctgaccagattagcagacttgaagaaagagaagcagaactgaagaaggaatataatgcattacatcaaagacacactgagatgatccataattatatggaacatttagaaagaacaaaacttcatcagctctcagggagtgatcaactagaatccacagctcatagtagaattagaaaagaacgccctatatcattaggaattttcccattacctgctggagatggattgcttacacctgatgctcagaaaggaggagagacccctggatctgagcaatggaaatttcaggaattaagtcaaccacgttctcataccagcctgaaggatgagctttctgatgttagccaaggcggatctaaagctaccactccagcatcaacagctaattcagatgtggcaacaattcctactgatactcccttaaaggaagaaaacgaaggatttgtgaaggttacagatgcgccaaataaatcagagataagcaaacacattgaagtacaggtagcccaggaaactagaaatgtatctactggctctgctgaaaatgaagaaaagtcagaagttcaagcaatcatcgaatctactcctgagctggatatggacaaagatctcagtggatataaaggttcaagcactcccaccaaaggcatagagaacaaagcttttgatcgcaatacagaatctctctttgaagaactgtcttcagctggctcaggcctaataggagatgtggatgaaggagcagatttactaggaatgggtcgggaagttgagaatcttatattagaaaatacacaactgttggaaaccaaaaatgctttgaacatagtgaagaatgatttgatagcaaaagtggatgaactgacctgtgagaaagatgtgctgcaaggggaattggaggctgtgaagcaagccaaactgaaactagaggaaaagaacagagaattggaggaagagcttaggaaagctcgggcagaagctgaagatgcaaggcaaaaagcaaaagatgacgatgatagtgatattcccacagcccagaggaaacggtttactagagtagaaatggcccgtgttctcatggagcgaaaccagtataaagagagattgatggagcttcaggaagctgttcgatggacagagatgattcgggcatcacgagaaaatccagccatgcaggaaaaaaaaaggtcaagcatttggcagttactgtcttcttttagtttcagccgacttttcagctcctcaagtaacacgactaagaagcctgaaccacctgttaatctgaagtacaatgcacccacgtctcatgttactccgtccgtcaagaaaagaagcagcaccttatctcagctccctggggataagtccaaagcctttgatttccttagtgaagaaactgaagctagtttagcctcacgcagagaacaaaagagagagcagtatcgtcaggtaaaagcacatgttcagaaggaagacggtagagtgcaggcttttggctggagtctgcctcagaagtacaaacaggtaaccaatggtcaaggtgaaaataagatgaaaaatttacctgtgcctgtctatctcagacctctggatgaaaaagatacatcaatgaagctgtggtgtgctgttggagtcaatttatctggtgggaagaccagagatggtggttctgttgttggagcaagtgtattttacaaggatgttgctggtttggatacagaaggcagtaaacagcgaagtgcctctcagagtagtttagataagttagatcaggaacttaaggaacagcagaaggagttaaaaaatcaagaagaattatccagtctagtttggatctgtaccagcactcattcggctacaaaagttcttattattgatgctgttcaacctggcaacatcctagacagtttcactgtttgcaactctcatgttctgtgcattgcaagtgtgccaggtgcacgagaaacagactaccctgcaggagaagatctttcagaatctggtcaggtagacaaagcatctttatgtggaagtatgacaagcaacagctcagcagagacagacagcctgttaggaggcatcacagtggttggttgttctgcagaaggtgtgacgggagctgccacttcccctagtacaaatggtgcttctccagtgatggataaaccaccagaaatggaagcagaaaatagtgaggttgatgaaaatgttccaacagcagaagaagcaactgaagctacagaagggaatgcggggtcagctgaagacacagtggacatctcccaaactggcgtctacacagagcatgtctttacagatcctttgggagttcagatcccagaagacctctccccagtgtatcagtcgagcaatgactcagatgcatataaagatcaaatatcagtactgccaaatgaacaagacttggtgagagaagaagcccagaaaatgagtagtcttttaccaactatgtggcttggagctcaaaatggctgtttgtatgtccattcatctgtagcccagtggaggaaatgtctccattccattaaacttaaagattcgattctcagtattgtacacgtgaagggaatcgtgttagtagccctggctgacggcacccttgcaatctttcacagaggagtggatgggcagtgggatttgtcaaactatcacctcttagaccttggacggcctcatcattccatccgttgcatgactgtggtacatgacaaagtctggtgtggctataggaacaaaatctatgtggtgcagccaaaggccatgaaaatagagaaatcttttgatgcacatcccaggaaggagagccaagtgcgacagcttgcgtgggtgggggatggcgtgtgggtctccattcgcttggattctacgctccgtctctatcatgcacacacttatcaacatctacaggatgtggacattgagccttatgtaagcaaaatgttaggtactggaaaactgggcttctcttttgtgagaattacagctcttatggtgtcttgtaatcgtttgtgggtggggacaggaaatggtgtcattatctccatcccattgacagaaacaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtcaagtcatcagcccacaaagtagcagtagtggcacggatctgacgggtgacaaagcagggccatctgcacaggagcctggtagtcagacgcccttgaagtctatgcttgtcatcagtggaggagagggctacatcgacttccgaatgggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccagagaatggtgatgttgattgagttttttccatgtaaaaaatgtacttgtttgccaaatgttcctagattgctcttaacctgttaatacaagtaaaactgtagtggggatggagtctggcctaagtacagaatgagggatttaattagaaaagttattttcttttgttctgtatcaaactgcagaacagctatatacttggtattttgtacgtgaataacgttttagcttttgtgcccttttgagcttgaagggttatcctcaaaggggaaaactatgaaggggaagaagacaaacctaagataccataaagtaaaggttgacattacatattttcattcacaatgcccattaaaaaaaaaaaataggttgggcatggtggctcacgcctgtaatcccaacactttaggaggctgaggcagatggattgcttgagcccaggagttcaagaccagcctgggcaacatggcgaaaccctgtctctaccaaaaaaaaaaaacaaaataaattaaccgggtgtggtggcacatgcctgtagtcccagctacttgggaggctgaggtgggaggatgacctgggcccaggaggtggaggttgcagtgagccttgatagcaccactgcactccagcctgggtgacggagcaagaccctgtctcaaaacagacaaacaagcaaaaaatagattaaagtctggatttcactgattttcttgcttaataagttttttaaaaccacgatgctgcaattttttccctctcaagcttcttgaaaatgtgtgatttacccttttttatctattactctaggcaaagctaaatatgatttttttttttttttttgagacggagtctggctctgttgcccaggctggaatgcagtggtgcgatctcagctcactgcaacctccacctctcaggttcaagtagttctcctgcctcagcctcccaagtagctgggattacaggtgtgtgccaccctgcccagctaatttttgtatttttagtagagacagggtttcaccacattggccaggctggtctcaaactcctgacctcagatgatctacccgccttggcctcccgaagtgcttgaattacaggcgtgagcccccgcgccggtccgaagcaaagctaaatgtaattttatgtactgttttaacagtataaacctatgggataaaggcccccaatcatcagaaggactactgaaaagaaaagaaagcaaacgtagatgtcaaattgtctaaacattcttaagtaccactgattttttttttctggactattatacaaagatgtctgtaaaaagtataccagtggcttttatgcatatacacgattaggctagattgtgaagtacatgggatttcatgagccagaggaggcatttggatccattgggccacatgtgactataagcacattgtgtacacaataaaattgtagccactcatgtattaaaactgttttggtaaaagctgtattaaaagaataattttttgcttgagctacttagtcacttttttgcagggcaccaaaatgtaggctacttttccatagcttgtttgctatgtttttatttcatcttaaatctgagccatttttggcaatatcttttaaaaaatcattattaaacatttattggaaatgttgtatagattcacaagaaagagacaccaaagtgtttgggaattttaatcccaagaagtaaacatcccagagtcagatcccatttgctgttgttcagccatgtttgtatgactgaatgtaatttaggaaatcaggagttagagatgaaaaatacaaacatgtcaaatggttgtaattgctttttttgaacttactggctttaacttaagtaatataggtgtgtagttgttttatctaaagatgtcagattatctgtggccctgttaattaactgcagggaccagagagaggacaaaaatgcctgtataatttgctttaaaggcttgtccttatgtttgtaatttcagttaaatattttctacagattgcttcacttcccctttcccccaataacaagttcatattcttgtaatgtttactttggtcaacgtggtaatttttggaagaaaatgccaaaatgtaagcttctcacaagcagcaaaggaatgtaactgcctgtagctaccacatcaagggagagaagaggcttgcgtactttgggttgatctcactgtacaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgta

SEQ ID NO: 185552 - DNA, 853 bp, Homo sapiens
  Payload ID: 16537
  Gene Symbol: SPA17
  Gene Name: sperm autoantigenic protein 17
  Uniprot ID: Q15506
  ENST ID: ENST00000227135
  CDS Start-End: 183-638
ttttgcagtcctcgcagcctcccgcgacctcaggactgggctgtactcgccccttctcggccgccgtagtttttttttttttttaaagaaaaaacggttacccagcaactagaaaaacaaccggaaccggcggcaccagctcggagagaaaggaggttccataggcagttcttaccaagaagatgtcgattccattctccaacacccactaccgaattccacaaggatttgggaatcttcttgaagggctgacacgcgagattctgagagagcaaccggacaatataccagcttttgcagcagcctattttgagagccttctagagaaaagagagaaaaccaactttgatccagcagaatgggggagtaaggtagaagaccgcttctataacaatcatgcattcgaggagcaagaaccacctgagaaaagtgatcctaaacaagaagagtctcagatatctgggaaggaggaagagacatcagtcaccatcttagactcttctgaggaagataaggaaaaagaagaggttgctgctgtcaaaatccaagctgccttccggggacacatagccagagaggaggcaaagaaaatgaaaacaaatagtcttcaaaatgaggaaaaagaggaaaacaagtgaggacactggttttacctccaggaaacatgaaaaataatccaaatccatcaaccttcttattaatgtcatttcttcctgaggaaggaagatttgatgttgtgaaataacattcgttactgttgtgaaaatctgtcatgagcatttgtttaataagcataccattgaaacatgccacttgaagatttctctgagatcatgagtttgtttacacttgt

SEQ ID NO: 185553 - DNA, 4949 bp, Homo sapiens
  Payload ID: 16537
  Gene Symbol: SPA17
  Gene Name: sperm autoantigenic protein 17
  Uniprot ID: Q15506
  ENST ID: ENST00000532692
  CDS Start-End: 1422-1877
tcgccccttctcggccgccgtagtttttttttttttttaaagaaaaaacggttacccagcaactagaaaaacaaccggaaccggcggcaccagctcggagagaaaggaggtgaggccgcttccccacttcctctccgataccaagacctagccttttcccttcgtctctcttattctctcagcatcccagacacagcctcggagccctgggccgtttgggagccgaggcagcccattctgcgcgagtctgaaatcccaggtcctcaacatcccgcccccgactagacccgtctgccccctccgcccgccctcctctgcccacattggttcagaatctcgccagctcttttcaccactctagaatggttcgatacccccatctactgctccctcagaaaaagcaaaagagaggagtcaggcgtggtggcgcgcgcctgtaatcccaattgctcgggaggctgaggcgggatcatcgctggagcccaggagttcgaggccagagaccccctctcaaagaaaaaaaaagcgatgaaacgagaaccctccatagtctgagcctcattaaaccgtccagttctcccaacctggacccctaccacggcctccgcctctattccgcattgacgcacactctcacattaacaggccaggtcccggaggattcttttcatactcagtagtagctcagcccgctgcttagcagctacccttaatctagcccttgtatttcaagacagaaagagacaacctgatcaagaagaaaccgaaaaatataagaattctaaaactttagaggctgggatttcaaaatcatgacacacagccccatcccatcccatccctccctcacacacacgcacgcacaaccccattccacagtacgaaggtgttcgaagcattgtgggtcatgcttcagaagtggcagcaaggggaaagattgtgcaacttcttcattcaacaaattaatttctagaaccaggactaatttctactctttaaaaaaaaatagacctcaaagaaggtcttctcagcaattgacaatgaatttaactttttagcaatcattctctctaaattcctgtgtgatagcaaaaattacccttaccttttgagcatataaagggtaaagagagaaaaagtcatattgaaaattatgggttttttgcaggattttaaatgatttggcctagtgaatgggtctgtgtttgtattatactaattcacaatggagatttcaaaactctttggaagaaatggatgggcttgggttgtgttagggaaaaaagaattcaagtccagatgtatgagtctcagaaataatttgttggcatagttgtgattatataagtaaaatcagacaaatttaaagacagtactctttaatgaatctttaggttccataggcagttcttaccaagaagatgtcgattccattctccaacacccactaccgaattccacaaggatttgggaatcttcttgaagggctgacacgcgagattctgagagagcaaccggacaatataccagcttttgcagcagcctattttgagagccttctagagaaaagagagaaaaccaactttgatccagcagaatgggggagtaaggtagaagaccgcttctataacaatcatgcattcgaggagcaagaaccacctgagaaaagtgatcctaaacaagaagagtctcagatatctgggaaggaggaagagacatcagtcaccatcttagactcttctgaggaagataaggaaaaagaagaggttgctgctgtcaaaatccaagctgccttccggggacacatagccagagaggaggcaaagaaaatgaaaacaaatagtcttcaaaatgaggaaaaagaggaaaacaagtgaggacactggttttacctccaggaaacatgaaaaataatccaaatccatcaaccttcttattaatgtcatttcttcctgaggaaggaagatttgatgttgtgaaataacattcgttactgttgtgaaaatctgtcatgagcatttgtttaataagcataccattgaaacatgccacttgaagatttctctgagatcatgagtttgtttacacttgtctcaagcctatctatagagacccttggatttagaattatagaactaaagtatctgagattacagagatctcagaggttatgtgttctaactattatcaaatgaataaatcctctctatcacatcccccaaaaatgttctttagctcctgtttcactcctagtggtaaagaatttcactgctttttaaggatagtctatttaattttggaatttttagaaagataagctgggacaaaaatctgcctccttcagcctggccaacatggtgaaaccccatgtctactaaaagtacaaaaattggccaggcgtggtgcgcacacctgtaatcccagctactcgggaggctgaggcaggagaatcgcttgaacctgggaagtggaggctgcagtaagccgagatcgcaccactgcactccagcctgggcgacagagcaagactctgtctcaaaaacaaaacaaaacaaaaaaaagcctctgcctccttgtaagtttaacccactggttttcatttatcatacatgtattcaatcatttattgaaaatgtattgagtactattcatgtgctgggaattagtagtgaatacttgttcttacactcatacaacttacaatgctttattgttttgctctccagaaccacacagaacaagactaataacatcatattgtaaaaagcaaaagctatcatatcatgctgccttcttcagttaaaacttcccaagtttttaaatatacaatggtaatgcctgtttaacaaactcagaggctttatctcttttatgttttcaatgattcattcaaatccctagtgccttagttttagaaagttccgtctctcctttttgaggcctctccacccttgattgtccaagaaactgagggttcatgtcttagaccaaagggtgcagttctcttcccaatacaaaaggtagaaagtggagtcttaccatttagttaatgctgttgccttctaccataatgttgtagcatagtccagcagactgaggtgattctctggctggttccaattcctgcctgcaccatagtggatggcccatgatttagttccaggattacatctctcttggtttatagtcacaaagccagtgttcccccaaagcttaaaaacaagccaggatggctcagtcctgaggagattctaaaaccaggtctatgttgtcacaacaaatactctcctacaaacactttgatccttgtcctaggcttagacatgctctttctgcaaagcagttttatttcaggtgcctcactgcccttccctggcactgagcctttatcaggctctgcaacagaggttcccccaagtgatcgccactcaaacacagttgattcacaccaaccctttcaaggttgtggctttcattctctaatgtccactcatacaggcagcctttctccttccaaaatcttgctgccactgtagagagtttcatgctagctaaacacaagtctctaatatcccccttcctctcctccttaacccctctcctccaggcttacagaggaaaagaaatcagttctcctccaggattccagctgttcgtccctcccattccactgaaagcaccagcttctaacaccttcccctctcagacagagccatcctgcttagcggattgtcaaggggggacccagaatttatgcaaagacttagattccctgacctggagagatcagaagaggaaaaaagggattttttccctagtgagtatatagcaggaaaaaaaaaaaagatgagttagctttttcagtaattctcctgttatacacataaagtgactagcactatgcattccatacacacacacacacacacacagatctcatggtagtgatattggtagtgaaggaggaaaaggaaaaggtgagcaatggatgtgatattatgagaacaacacatatgaatgacactttattagaacttatctggttttcctcttatctctctggctgttccttctcaattcccttcactggtaactcttcaactccccaaccactaaatgctaagtgcccttaggctcagtctttcgaccccatttctacactcacttgatttcctgcagtttcatagctttaaaatccaatcttcttaatgatcactcccagacctttctctcctctgcctgcgaacttctatattcaactgcctacataacatccccatttggatgtctataggcatctcaaaagtaacatataaaaaatgaatcctgatattgcccccaaatctgaaacttcccccacacccaagtttttccattcaaaaatggctgctccattcttccatttgctcaggccaaaaaccttggattcatctttaatgcgtcactttctttcacaccccatatacaatctatcagcaaaacctgtgggctgtacctataaaataatactcagaatctgcctacttctaaccacttccattgttaccgccttggtcctagttcccatgatagccttgtgaattattgcaataacctatattggccagtgattatctcactactactgcacaacccattccaaagttagtggtttaagacaattatattttctcctgggtctgtaggtcagtggtaatgtagctaagctaggctggactacaatctcaaggttaggttcaggtcagctctaagctgtgggtttgtgggctgacaggaaggtctgcttcaggctgtgggcccaagggtcagctgcagcacagtgcctctgcttcacgtgtccttttctgagcccctgctgaaagacgttatccaggacaagctcttctcatgctggtcacagaagacaagcaggaaaacccagcatgcaagaatatttcaagcttttgctc

SEQ ID NO: 185554 - DNA, 1431 bp, Homo sapiens
  Payload ID: 16538
  Gene Symbol: SPESP1
  Gene Name: sperm equatorial segment protein 1
  Uniprot ID: Q6UW49
  ENST ID: ENST00000310673
  CDS Start-End: 155-1207
ctgcgcttgcgcgctggggacaaccgttgctgggtgtcccagggcctgaggcaggacggtactccgctgacaccttccctttcggccttgaggttcccagcctggtggccccaggacgttccggtcgcatggcagagtgctacggacgacgcctatgaagcccttagtccttctagttgcgcttttgctatggccttcgtctgtgccggcttatccgagcataactgtgacacctgatgaagagcaaaacttgaatcattatatacaagttttagagaacctagtacgaagtgttccctctggggagccaggtcgtgagaaaaaatctaactctccaaaacatgtttattctatagcatcaaagggatcaaaatttaaggagctagttacacatggagacgcttcaactgagaatgatgttttaaccaatcctatcagtgaagaaactacaactttccctacaggaggcttcacaccggaaataggaaagaaaaaacacacggaaagtaccccattctggtcgatcaaaccaaacaatgtttccattgttttgcatgcagaggaaccttatattgaaaatgaagagccagagccagagccggagccagctgcaaaacaaactgaggcaccaagaatgttgccagttgttactgaatcatctacaagtccatatgttacctcatacaagtcacctgtcaccactttagataagagcactggcattgggatctctacagaatcagaagatgttcctcagctctcaggtgaaactgcgatagaaaaacccgaagagtttggaaagcacccagagagttggaataatgatgacattttgaaaaaaattttagatattaattcacaagtgcaacaggcacttcttagtgacaccagcaacccagcatatagagaagatattgaagcctctaaagatcacctaaaacgaagccttgctctagcagcagcagcagaacataaattaaaaacaatgtataagtcccagttattgccagtaggacgaacaagtaataaaattgatgacatcgaaactgttattaacatgctgtgtaattctagatctaaactctatgaatatttagatattaaatgtgttccaccagagatgagagaaaaagctgctacagtattcaatacattaaaaaatatgtgtagatcaaggagagtcacagccttattaaaagtttattaaacaataatataaaaattttaaacctacttgatattccataacaaagctgatttaagcaaactgcattttttcacaggagaaataatcatattcgtaatttcaaaagttgtataaaaatattttctattgtagttcaaatgtgccaacatctttatgtgtcatgtgttatgaacaattttcatatgcactaaaaacctaatttaaaataaaattttggttcagga

SEQ ID NO: 185555 - DNA, 1580 bp, Homo sapiens
  Payload ID: 16539
  Gene Symbol: SPEF1
  Gene Name: sperm flagellar 1
  Uniprot ID: Q9Y4P9
  ENST ID: ENST00000379756
  CDS Start-End: 162-872
agaaaacaatatggccgctcccagctgggacgtgagtctctggattaggcaggcagaggcagttatgggcttctgcagtggcgagaaaggaagcgcctgaagggtcgtgaggctggggcgggacccggcaccgctggggcggccaggccgtgaggacgccaatggcgagcagcgtggacgaggaggcgctgcaccagctgtacctgtgggtagacaacatccctctgtcccggcccaagcgaaacctctcccgggactttagcgatggagtccttgttgcagaggtcatcaagttttacttccccaagatggtggagatgcacaattatgtccccgccaactctctccagcagaagctcagcaactggggtcatctgaacaggaaggtactgaagaggctgaacttttcagtaccggatgacgtgatgcgcaagatcgcgcagtgcgccccaggcgtggtggagctggtgctcatcccgctgaggcagcgcctggaggagaggcagaggcgcaggaagcagggcgccggctccttacaggagctggctccccaggatggcagtggctacatggatgtgggtgtatcccagaaggcccgaggtgaaggtgtcccggacccccagggagggggtcagctcagctgggaccggccgccggcgcctcggcctccagcgtataaccgggcgttgcagggcgaccccagcttcgtcctccagatcgctgaaaaggagcaggagctgttggcctctcaagagaccgtgcaggtcctgcagatgaaggtaaggcgcctggagcacctgctccagctcaagaatgtgcggatcgaagacctctcccggcggctccagcaggcggagcgtaagcagcggtgagcggcggcccgggccgcgcggggacgcccgggtacccgccagagccccgacgccgcgccggacccacccaccgatggatagaccattgggagggcggagcccgctgctctcacgagcctgctggggcccgagtgccctccttccttgggatgggtgagcgtgggaggagatgggacaggaactctaggagcgcaggcccgggactgagccgcctcctaccactccggagatccgggtcaggagaatggaccgctttccagagcccagaagccacgtgcagagacctagcctgtcccccaaagcagtgtccaacaccttgggcccggccttgcatctcccggcgctgggccttggggggcggtcccttggctctgtccacacccccagaatcaggtccccgcccagctccgaggacggcggcgtctccatccaggctagttccccatgccctcagccatgggggaatctgtcccgggccgctgaggggctcccctgcccctcctgggagcttacctgggacccacctcggcgacggagaccgcagcagctggagaggaaggggtgaggcgtgggatcgccaggagtagggaggacatcgacgatgtgcccgtagcagtcgcccctccctcctcgcgcacggggtactgaggcggaaggtttgaaggttacggctcagggctgccccattaaagtcagtgttgtgttcta

SEQ ID NO: 185556 - DNA, 3026 bp, Homo sapiens
  Payload ID: 16540
  Gene Symbol: SPEF2
  Gene Name: sperm flagellar 2
  Uniprot ID: Q9C093
  ENST ID: ENST00000282469
  CDS Start-End: 155-1699
gtcccctcttctctaaggcctttcgcctagttccagcctggatacgcttccatagcaaagggttgcccttggctacaggaggacgcgggctggcaggcttggttcctggcgagtttctaagcccccgcctgcggtctgaggcaccggctgaaccatgtcggagatcctgtgccagtggctcaacaaggagttgaaggtgtcccggaccgtgagtcccaagtcatttgcaaaggcattttccagtggctatctacttggagaagttctacacaagtttgaacttcaggatgatttttcagaatttttggacagcagggtttcaagtgccaaacttaataatttttctcgcttggagccaacacttaaccttctgggtgtgcagtttgatcagaatgtggcccatggcatcatcacagaaaagcctggggtggcaacaaagctgttatatcaattgtacattgctcttcagaaaaagaagaaaagtggactgactggagtggagatgcaaaccatgcaacgtctgacaaatttaagacttcaaaacatgaaaagtgatacttttcaagagagacttagacacatgataccacgtcaaactgatttcaatctgatgcggattacatacaggtttcaagaaaaatataaacacgtgaaagaagatcttgcccatttgcattttgagaaacttgaaagatttcaaaaactcaaggaagagcaaagatgttttgatattgaaaagcaatacttaaacagaagacgacaaaatgaaataatggccaaaatccaagcagctattatacagattcctaaacctgcatcaaatcgtactttgaaagcactcgaggcccaaaaaatgatgaaaaagaaaaaagaggcagaagatgtggctgatgaaattaagaagttcgaagcattaataaaaaaggatctccaagcaaaagaaagtgcatccaagacttctttagatacagcaggccagacaaccaccgatttgttaaatacttactcagatgacgagtacattaaaaaaatccagaagcgccttgaagaagatgcttttgcacgagagcaaagggagaaaagacggcggaaattgttaatggaccagttaatagcccacgaagcacaagaggaggcttatcgggaggaacagctgattaaccggctgatgcggcagtcccagcaggagcgcaggattgccgtgcagctcatgcatgttcggcatgaaaaggaagttttatggcaaaacagaattttcagagaaaaacaacatgaggaaagacgacttaaagatttccaggatgctcttgatcgagaagcggctttggcaaaacaagccaagattgactttgaagaacaattccttaaagaaaagagatttcatgatcagattgctgtggaaagagctcaagctcgttatgaaaagcattattcagtatgtgcagaaattttggatcaaatagttgatttgtccactaaagtggcagactatcgaatgttgacaaataatctgattccgtataagttgatgcatgattggaaggaactattttttaatgcaaaacccatatatgaacaagcctctgttaagacactacctgctaacccctcaagagaacaacttacagaactggagaaaagggacttgctagataccaatgattatgaagaatataaggtacctactgatatgaaataattagaatgctacataataaatcctttttctttaacattaattttgtgatattccttatttcatttctactaataaaaatagacatgttttgtttgcattttcccttgttttaatttgtatgtttgtactactttttagatgcttaaactatacataagctattatctattgttcctagtaatcttaggggagtggtctgaaaaaacatcaagcatagtaattgtctgggtagacagatttcagaatttttaaaatgctttaatttatttattagcatttttctttgtatgggctgtgtacttttgcttcaaaaaccattgttaaaaagtatttcttttgtaatcaatctaaataatagactttttttacaggcaaaatgaaagaggaggaagtctgggttttatgaatagcatagattcaaacaatcttttattcaaagattgaaataaaaagtatcgggtgccaactgtgatttttagaagaactgttgtaaagcctttgagattagacagactagagctacattactgaaattgccaactactaactgtgtgaccttaggtgaccagttcattaagggctaatagatttccatttttcaattaatggaaagggaatgctactatacctacttcatttaaaataacatgagttaaacacttagctgagtgcacttcatgttggatgcatataatacatatccatttctttcctcaccatcctactctccccatcccactccatctcacccttagaagtaaaggtgtaacaatcatagcttttggatagaaattttgagtggatcaacagcaatggaatgaggagtgaggctttttattagaaaaattacaaaatgagtcccggaaggtcagtaagtgcaacatgaaaaaaatctatgaaaagattatttgacctaattattcactgatagtacatactcaacaaaggtttgtgggacaaagggtgaataaaatgaatgaattacaatgaacaaagaaaagtgcaaaataacactaacaagtaaatattacaagaagataaccttgtggttaaaagataaggaaaaatatgagattatgagaaattaaatgtatactatattttaattaaatgaatctgtatttgtagcactaagagaattattattaaggattgactagaaccttaaaagatatatgtggatgtttgttttgtacggttgtaaaatatactagacctattacatccacctaaagtataatgccatgtaagaaaatgctttgacagtatcaacctgtgttaaggtatttctttccattgtaaattaaaagtcattttatttgacaga

SEQ ID NO: 185557 - DNA, 5681 bp, Homo sapiens
  Payload ID: 16540
  Gene Symbol: SPEF2
  Gene Name: sperm flagellar 2
  Uniprot ID: Q9C093
  ENST ID: ENST00000356031
  CDS Start-End: 155-5623
gtcccctcttctctaaggcctttcgcctagttccagcctggatacgcttccatagcaaagggttgcccttggctacaggaggacgcgggctggcaggcttggttcctggcgagtttctaagcccccgcctgcggtctgaggcaccggctgaaccatgtcggagatcctgtgccagtggctcaacaaggagttgaaggtgtcccggaccgtgagtcccaagtcatttgcaaaggcattttccagtggctatctacttggagaagttctacacaagtttgaacttcaggatgatttttcagaatttttggacagcagggtttcaagtgccaaacttaataatttttctcgcttggagccaacacttaaccttctgggtgtgcagtttgatcagaatgtggcccatggcatcatcacagaaaagcctggggtggcaacaaagctgttatatcaattgtacattgctcttcagaaaaagaagaaaagtggactgactggagtggagatgcaaaccatgcaacgtctgacaaatttaagacttcaaaacatgaaaagtgatacttttcaagagagacttagacacatgataccacgtcaaactgatttcaatctgatgcggattacatacaggtttcaagaaaaatataaacacgtgaaagaagatcttgcccatttgcattttgagaaacttgaaagatttcaaaaactcaaggaagagcaaagatgttttgatattgaaaagcaatacttaaacagaagacgacaaaatgaaataatggccaaaatccaagcagctattatacagattcctaaacctgcatcaaatcgtactttgaaagcactcgaggcccaaaaaatgatgaaaaagaaaaaagaggcagaagatgtggctgatgaaattaagaagttcgaagcattaataaaaaaggatctccaagcaaaagaaagtgcatccaagacttctttagatacagcaggccagacaaccaccgatttgttaaatacttactcagatgacgagtacattaaaaaaatccagaagcgccttgaagaagatgcttttgcacgagagcaaagggagaaaagacggcggaaattgttaatggaccagttaatagcccacgaagcacaagaggaggcttatcgggaggaacagctgattaaccggctgatgcggcagtcccagcaggagcgcaggattgccgtgcagctcatgcatgttcggcatgaaaaggaagttttatggcaaaacagaattttcagagaaaaacaacatgaggaaagacgacttaaagatttccaggatgctcttgatcgagaagcggctttggcaaaacaagccaagattgactttgaagaacaattccttaaagaaaagagatttcatgatcagattgctgtggaaagagctcaagctcgttatgaaaagcattattcagtatgtgcagaaattttggatcaaatagttgatttgtccactaaagtggcagactatcgaatgttgacaaataatctgattccgtataagttgatgcatgattggaaggaactattttttaatgcaaaacccatatatgaacaagcctctgttaagacactacctgctaacccctcaagagaacaacttacagaactggagaaaagggacttgctagataccaatgattatgaagaatataagaacatggttggagagtgggccttaccagaagaaatggttgacaatttaccaccctccaacaattgcatactgggccatattcttcacaggctagctgaaaaatctcttcctcctcgagcggaatcaacaacacctgaattaccttcatttgctgttaaaggatgcttattggggaaaacattaagtggaaaaactaccattttaaggtctctacaaaaagactttcctatacagatactttctattgacactcttgtccaagaagctatccaagcatttcatgacaatgaaaaagtcagtgaggttctaccaattcagaaaaatgatgaagaagatgctctaccagttctgcaagaggagattaaagaaagccaggatccacaacatgtattttcagctggtccagtttcagatgaagtattaccagaaacagaaggtgaaacaatgcttagtgctaatgctgataaaacaccaaaagctgaagaagtcaaatcaagtgatagtttcttaaaactcactacacgtgctcagcttggtgcaaaatcagaacagttgctgaagaaaggaaagagcattcctgatgtgctgcttgttgacatcatagtaaatgctattaatgagatacctgtgaatcaagactgtatcctagatggttttccaatgactttaaaccaagcacagcttctggaagaagctcttacaggctgcaatagaaacctcacagaagtggaaagaaaaaaagcacaaaaatccacattggctattgatcctgcgacttccaaagaaatacctcttccctctcctgcatttgattttgtcatattattagatgtttcagatacttcctcaatgagtcgcatgaatgatattatagctgaagaattgtcctataaaactgctcacgaagatatcagtcaacgtgtagctgctgaaaaccaagataaggatggagaccaaaatttaagagaccagatacaacatagaattataggcttcttggacaactggcctttattggagcaatggttttcagagccagaaaatattttgataaaaatcaatgctgaaatagataaggaatctttatgtgaaaaagtaaaagaaattcttacgactgaaatagcaaaaaaaaagaataaagttgagaagaaattagaagaaaaggaagctgagaaaaaagcagcagcttccctggctgagcttccacttcctacacctcctcctgctcctcctcctgaaccagaaaaagagaaggaaattcatcaaagccatgtggcttcaaaaactcctactgcaaaaggaaaacctcaatcagaagccccgcatggtaagcaagaatctcttcaggaaggaaaagggaagaaaggtgagaccgcactcaaaagaaaaggttctcctaaaggaaaatcatcaggaggaaaagtaccagtaaagaaatcacctgctgactctacagatacatcacctgttgcaatagtgccacagccacctaagccaggatcagaagaatgggtctatgtgaatgaaccagttcctgaggaaatgcctttgtttttagtaccttactgggaactaatagaaaattcctatataaacaccatcaaaacagtactcaggcatctgagggaagaccagcatactgtgcttgcttacttatatgagattagaacaagtttccaggagtttctaaagcgtccggatcacaagcaagattttgtagctcaatggcaggctgatttcaactcccttcctgatgacctgtgggatgatgaggaaacaaaggctgaactacatcaacgagtgaatgatctgcgagaccgcctgtgggacatttgtgatgcccggaaggaagaggcggagcaggagcggcttgacatcattaatgagagctggttacaggacactcttggaatgacaatgaaccatttcttttccctgatgcaggcagagctgaaccgtttccaagatacaaagagactccttcaagattattactggggaatggaaagtaaaatcccagtagaggacaacaagagatttactcgaatccctttggtccaactggatagtaaagacaattctgaaagccagcttagaattcctctagttcctcgaatatccatttctctggaaacagttacacccaaaccaaaaacaaaatcagtactgaagggcaagatggataactccctagaaaacgttgagtccaactttgaggccgatgaaaagttggtcatggacacctggcagcaggcttctttagcagtatctcacatggtggctgctgaaattcatcagaggcttatggaagaagaaaaagaaaaccagccagcagaccccaaagaaaaatctcctcagatgggtgcaaataaaaaagtcaaaaaggagccacccaagaaaaaacaggaagacaaaaaacccaaaggtaaatcaccacctatggcagaagcaactcctgtcatagtaacaacagaggaaattgctgaaatcaaaaggaaaaatgaactgagggtcaaaataaaagaagaacaccttgctgccttgcaatttgaagaaatagccacgcaatttcgacttgaactgataaagacaaaagcattggctcttcttgaagatttagtaacaaaggtggttgatgtatataaactcatggaaaaatggcttggtgagaggtatttgaatgaaatggccagtacagaaaaattaactgacgtagctcgctatcacattgaaacatctacaaaaattcagaatgaactttatttaagccaagaagacttcttcattaatggcaatataaaagtcttcccagatcctcccccatcaatacgtcctccacctgtagaaaaggaagaagatggtaccctgaccattgaacagcttgacagtcttcgagatcagttcttagatatggcacctaaaggcataataggaaataaagcatttactgacattctgatcgatttggtgaccctgaaccttggcacaaacaactttcctagtaattggatgcaccttacccaacctgaattacaggaattaacatctttattaacagtcaactccgagttcgtggactggcggaagttcctgttagtaacctcaatgccttggcccattcccttggaggaggagctccttgagacccttcagaagttcaaggctgtggataaggagcagttgggcaccatcacttttgagcagtatatgcaggctggtctgtggtttacaggagatgaagatataaaaattccagaaaatcctcttgaaccccttccatttaataggcaggagcatcttatagagtttttctttaggctatttgctgactatgagaaggatccaccccagcttgactacacacagatgctgctttactttgcttgccacccagacaccgtggaaggagtctacagggccctcagtgtggctgttggaactcatgtcttccaacaagtcaaagcttccattccaagtgcagaaaagacctcctcaactgatgcaggtccagctgaggaatttcctgaacctgaggaaaatgctgcaagagaagaaaggaaattaaaagacgacacggagaaaagggaacagaaggatgaagaaatccctgaaaatgcaaacaatgaaaagatgtccatggaaacactactcaaagtgttcaaagggggaagtgaagcacaggactccaatagatttgccagccacctaaagatagagaacatttatgcagagggcttcataaaaacatttcaagacctaggtgccaagaacctggagccaattgaagtcgctgttctcttgaagcatccttttattcaagacctgatttcaaattattcagactataagtttcctgatattaaaataattctccaaaggagtgaacatgtacaaggaagtgatggagagagatcaccttcaagacatacagaggaaaagaaatgaagacaaaagagtgtgatttttttaattctgcaataaatcttccaaaaattaaatgtga

SEQ ID NO: 185558 - DNA, 5964 bp, Homo sapiens
  Payload ID: 16540
  Gene Symbol: SPEF2
  Gene Name: sperm flagellar 2
  Uniprot ID: Q9C093
  ENST ID: ENST00000440995
  CDS Start-End: 1-5457
atgtcggagatcctgtgccagtggctcaacaaggagttgaaggtgtcccggaccgtgagtcccaagtcatttgcaaaggcattttccagtggctatctacttggagaagttctacacaagtttgaacttcaggatgatttttcagaatttttggacagcagggtttcaagtgccaaacttaataatttttctcgcttggagccaacacttaaccttctgggtgtgcagtttgatcagaatgtggcccatggcatcatcacagaaaagcctggggtggcaacaaagctgttatatcaattgtacattgctcttcagaaaaagaagaaaagtggactgactggagtggagatgcaaaccatgcaacgtctgacaaatttaagacttcaaaacatgaaaagtgatacttttcaagagagacttagacacatgataccacgtcaaactgatttcaatctgatgcggattacatacaggtttcaagaaaaatataaacacgtgaaagaagatcttgcccatttgcattttgagaaacttgaaagatttcaaaaactcaaggaagagcaaagatgttttgatattgaaaagcaatacttaaacagaagacgacaaaatgaaataatggccaaaatccaagcagctattatacagattcctaaacctgcatcaaatcgtactttgaaagcactcgaggcccaaaaaatgatgaaaaagaaaaaagaggcagaagatgtggctgatgaaattaagaagttcgaagcattaataaaaaaggatctccaagcaaaagaaagtgcatccaagacttctttagatacagcaggccagacaaccaccgatttgttaaatacttactcagatgacgagtacattaaaaaaatccagaagcgccttgaagaagatgcttttgcacgagagcaaagggagaaaagacggcggaaattgttaatggaccagttaatagcccacgaagcacaagaggaggcttatcgggaggaacagctgattaaccggctgatgcggcagtcccagcaggagcgcaggattgccgtgcagctcatgcatgttcggcatgaaaaggaagttttatggcaaaacagaattttcagagaaaaacaacatgaggaaagacgacttaaagatttccaggatgctcttgatcgagaagcggctttggcaaaacaagccaagattgactttgaagaacaattccttaaagaaaagagatttcatgatcagattgctgtggaaagagctcaagctcgttatgaaaagcattattcagtatgtgcagaaattttggatcaaatagttgatttgtccactaaagtggcagactatcgaatgttgacaaataatctgattccgtataagttgatgcatgattggaaggaactattttttaatgcaaaacccatatatgaacaagcctctgttaagacactacctgctaacccctcaagagaacaacttacagaactggagaaaagggacttgctagataccaatgattatgaagaatataagaacatggttggagagtgggccttaccagaagaaatggttgacaatttaccaccctccaacaattgcatactgggccatattcttcacaggctagctgaaaaatctcttcctcctcgagcggaatcaacaacacctgaattaccttcatttgctgttaaaggatgcttattggggaaaacattaagtggaaaaactaccattttaaggtctctacaaaaagactttcctatacagatactttctattgacactcttgtccaagaagctatccaagcatttcatgacaatgaaaaagtcagtgaggttctaccaattcagaaaaatgatgaagaagatgctctaccagttctgcaagaggagattaaagaaagccaggatccacaacatgtattttcagctggtccagtttcagatgaagtattaccagaaacagaaggtgctaatgctgataaaacaccaaaagctgaagaagtcaaatcaagtgatagtttcttaaaactcactacacgtgctcagcttggtgcaaaatcagaacagttgctgaagaaaggaaagagcattcctgatgtgctgcttgttgacatcatagtaaatgctattaatgagatacctgtgaatcaagactgtatcctagatggttttccaatgactttaaaccaagcacagcttctggaagaagctcttacaggctgcaatagaaacctcacagaagtggaaagaaaaaaagcacaaaaatccacattggctattgatcctgcgacttccaaagaaatacctcttccctctcctgcatttgattttgtcatattattagatgtttcagatacttcctcaatgagtcgcatgaatgatattatagctgaagaattgtcctataaaactgctcacgaagatatcagtcaacgtgtagctgctgaaaaccaagataaggatggagaccaaaatttaagagaccagatacaacatagaattataggcttcttggacaactggcctttattggagcaatggttttcagagccagaaaatattttgataaaaatcaatgctgaaatagataaggaatctttatgtgaaaaagtaaaagaaattcttacgactgaaatagcaaaaaaaaagaataaagttgagaagaaattagaagaaaaggaagctgagaaaaaagcagcagcttccctggctgagcttccacttcctacacctcctcctgctcctcctcctgaaccagaaaaagagaaggaaattcatcaaagccatgtggcttcaaaaactcctactgcaaaaggaaaacctcaatcagaagccccgcatggtaagcaagaatctcttcaggaaggaaaagggaagaaaggtgagaccgcactcaaaagaaaaggttctcctaaaggaaaatcatcaggaggaaaagtaccagtaaagaaatcacctgctgactctacagatacatcacctgttgcaatagtgccacagccacctaagccaggatcagaagaatgggtctatgtgaatgaaccagttcctgaggaaatgcctttgtttttagtaccttactgggaactaatagaaaattcctatataaacaccatcaaaacagtactcaggcatctgagggaagaccagcatactgtgcttgcttacttatatgagattagaacaagtttccaggagtttctaaagcgtccggatcacaagcaagattttgtagctcaatggcaggctgatttcaactcccttcctgatgacctgtgggatgatgaggaaacaaaggctgaactacatcaacgagtgaatgatctgcgagaccgcctgtgggacatttgtgatgcccggaaggaagaggcggagcaggagcggcttgacatcattaatgagagctggttacaggacactcttggaatgacaatgaaccatttcttttccctgatgcaggcagagctgaaccgtttccaagatacaaagagactccttcaagattattactggggaatggaaagtaaaatcccagtagaggacaacaagagatttactcgaatccctttggtccaactggatagtaaagacaattctgaaagccagcttagaattcctctagttcctcgaatatccatttctctggaaacagttacacccaaaccaaaaacaaaatcagtactgaagggcaagatggataactccctagaaaacgttgagtccaactttgaggccgatgaaaagttggtcatggacacctggcagcaggcttctttagcagtatctcacatggtggctgctgaaattcatcagaggcttatggaagaagaaaaagaaaaccagccagcagaccccaaagaaaaatctcctcagatgggtgcaaataaaaaagtcaaaaaggagccacccaagaaaaaacaggaagacaaaaaacccaaaggtaaatcaccacctatggcagaagcaactcctgtcatagtaacaacagaggaaattgctgaaatcaaaaggaaaaatgaactgagggtcaaaataaaagaagaacaccttgctgccttgcaatttgaagaaatagccacgcaatttcgacttgaactgataaagacaaaagcattggctcttcttgaagatttagtaacaaaggtggttgatgtatataaactcatggaaaaatggcttggtgagaggtatttgaatgaaatggccagtacagaaaaattaactgacgtagctcgctatcacattgaaacatctacaaaaattcagaatgaactttatttaagccaagaagacttcttcattaatggcaatataaaagtcttcccagatcctcccccatcaatacgtcctccacctgtagaaaaggaagaagatggtaccctgaccattgaacagcttgacagtcttcgagatcagttcttagatatggcacctaaaggcataataggaaataaagcatttactgacattctgatcgatttggtgaccctgaaccttggcacaaacaactttcctagtaattggatgcaccttacccaacctgaattacaggaattaacatctttattaacagtcaactccgagttcgtggactggcggaagttcctgttagtaacctcaatgccttggcccattcccttggaggaggagctccttgagacccttcagaagttcaaggctgtggataaggagcagttgggcaccatcacttttgagcagtatatgcaggctggtctgtggtttacaggagatgaagatataaaaattccagaaaatcctcttgaaccccttccatttaataggcaggagcatcttatagagtttttctttaggctatttgctgactatgagaaggatccaccccagcttgactacacacagatgctgctttactttgcttgccacccagacaccgtggaaggagtctacagggccctcagtgtggctgttggaactcatgtcttccaacaagtcaaagcttccattccaagtgcagaaaagacctcctcaactgatgcaggtccagctgaggaatttcctgaacctgaggaaaatgctgcaagagaagaaaggaaattaaaagacgacacggagaaaagggaacagaaggatgaagaaatccctgaaaatgcaaacaatgaaaagatgtccatggaaacactactcaaagtgttcaaagggggaagtgaagcacaggactccaatagatttgccagccacctaaagatagagaacatttatgcagagggcttcataaaaacatttcaagacctaggtgccaagaacctggagccaattgaagtcgctgttctcttgaagcatccttttattcaagacctgatttcaaattattcagactataagtttcctgtacacatcatctatgtagtggaaatgatagtgtgtgcaaaaggttgggcaccacttccatcaggaaaacagtgtgcaagatggagaaactaaggacaaaccccagagaaactggacaaacccagcagaagaaaggaagaactgcaactcagaaatcacataaccaccaagcaggtctggaccacacatgctaaatgtgcatccactatggcgagtcccaggcctttaacagcagggactaaggagggcagaggctgacaccaaccccctttcatactgtagcactacatccctctcagataccagtttaacacgaagtctccctgtttgactcctgtgagttgtgtattgaactacaaagtgtttgctgagttgaaaataaaagcgctttcactttgatagaatgtagattgtgtatcttgacttctcaatgatagcaagttacattttgcagttttcttcctatacccacaaatgaaactattcagacttaaatatcttcctgtgtgcctaaacgtttttgttctaagttgctgatccttttaaatattaaattattaattaatattaaaattaattttattgcctgtattagtataa

SEQ ID NO: 185559 - DNA, 547 bp, Homo sapiens
  Payload ID: 16540
  Gene Symbol: SPEF2
  Gene Name: sperm flagellar 2
  ENST ID: ENST00000508817
  CDS Start-End: 1-348
caaaaatccacattggctattgatcctgcgacttccaaagaaatacctcttccctctcctgcatttgattttgtcatattattagatgtttcagatacttcctcaatgagtcgcatgaatgatattatagaccagcaggatcctgggctgagtgggagcctagccactagggttgggtgcaacatgcagttctgcagtgctcggggtctatggaggaacctgaagaacatcttcacagagaaacacactacatccaaagccacgtgggctacaaagtcctgccagggctgggctgagctgaagaattgtcctataaaactgctcacgaagatatcagtcaacgtgtagctgctgaaaaccaagataaggatggagaccaaaatttaagagaccagatacaacatagaattataggcttcttggacaactggcctttattggagcaatggttttcagagccagaaaatattttgataaaaatcaatgctgaaatagataaggaatctttatgtgaaaaagtaaaagaaattcttacgactgaaatagc

SEQ ID NO: 185560 - DNA, 4707 bp, Homo sapiens
  Payload ID: 16540
  Gene Symbol: SPEF2
  Gene Name: sperm flagellar 2
  ENST ID: ENST00000509059
  CDS Start-End: 155-2986
gtcccctcttctctaaggcctttcgcctagttccagcctggatacgcttccatagcaaagggttgcccttggctacaggaggacgcgggctggcaggcttggttcctggcgagtttctaagcccccgcctgcggtctgaggcaccggctgaaccatgtcggagatcctgtgccagtggctcaacaaggagttgaaggtgtcccggaccgtgagtcccaagtcatttgcaaaggcattttccagtggctatctacttggagaagttctacacaagtttgaacttcaggatgatttttcagaatttttggacagcagggtttcaagtgccaaacttaataatttttctcgcttggagccaacacttaaccttctgggtgtgcagtttgatcagaatgtggcccatggcatcatcacagaaaagcctggggtggcaacaaagctgttatatcaattgtacattgctcttcagaaaaagaagaaaagtggactgactggagtggagatgcaaaccatgcaacgtctgacaaatttaagacttcaaaacatgaaaagtgatacttttcaagagagacttagacacatgataccacgtcaaactgatttcaatctgatgcggattacatacaggtttcaagaaaaatataaacacgtgaaagaagatcttgcccatttgcattttgagaaacttgaaagatttcaaaaactcaaggaagagcaaagatgttttgatattgaaaagcaatacttaaacagaagacgacaaaatgaaataatggccaaaatccaagcagctattatacagattcctaaacctgcatcaaatcgtactttgaaagcactcgaggcccaaaaaatgatgaaaaagaaaaaagaggcagaagatgtggctgatgaaattaagaagttcgaagcattaataaaaaaggatctccaagcaaaagaaagtgcatccaagacttctttagatacagcaggccagacaaccaccgatttgttaaatacttactcagatgacgagtacattaaaaaaatccagaagcgccttgaagaagatgcttttgcacgagagcaaagggagaaaagacggcggaaattgttaatggaccagttaatagcccacgaagcacaagaggaggcttatcgggaggaacagctgattaaccggctgatgcggcagtcccagcaggagcgcaggattgccgtgcagctcatgcatgttcggcatgaaaaggaagttttatggcaaaacagaattttcagagaaaaacaacatgaggaaagacgacttaaagatttccaggatgctcttgatcgagaagcggctttggcaaaacaagccaagattgactttgaagaacaattccttaaagaaaagagatttcatgatcagattgctgtggaaagagctcaagctcgttatgaaaagcattattcagtatgtgcagaaattttggatcaaatagttgatttgtccactaaagtggcagactatcgaatgttgacaaataatctgattccgtataagttgatgcatgattggaaggaactattttttaatgcaaaacccatatatgaacaagcctctgttaagacactacctgctaacccctcaagagaacaacttacagaactggagaaaagggacttgctagataccaatgattatgaagaatataagaacatggttggagagtgggccttaccagaagaaatggttgacaatttaccaccctccaacaattgcatactgggccatattcttcacaggctagctgaaaaatctcttcctcctcgagcggaatcaacaacacctgaattaccttcatttgctgttaaaggatgcttattggggaaaacattaagtggaaaaactaccattttaaggtctctacaaaaagactttcctatacagatactttctattgacactcttgtccaagaagctatccaagcatttcatgacaatgaaaaagtcagtgaggttctaccaattcagaaaaatgatgaagaagatgctctaccagttctgcaagaggagattaaagaaagccaggatccacaacatgtattttcagctggtccagtttcagatgaagtattaccagaaacagaaggtgctaatgctgataaaacaccaaaagctgaagaagtcaaatcaagtgatagtttcttaaaactcactacacgtgctcagcttggtgcaaaatcagaacagttgctgaagaaaggaaagagcattcctgatgtgctgcttgttgacatcatagtaaatgctattaatgagatacctgtgaatcaagactgtatcctagatggttttccaatgactttaaaccaagcacagcttctggaagaagctcttacaggctgcaatagaaacctcacagaagtggaaagaaaaaaagcacaaaaatccacattggctattgatcctgcgacttccaaagaaatacctcttccctctcctgcatttgattttgtcatattattagatgtttcagatacttcctcaatgagtcgcatgaatgatattatagctgaagaattgtcctataaaactgctcacgaagatatcagtcaacgtgtagctgctgaaaaccaagataaggatggagaccaaaatttaagagaccagatacaacatagaattataggcttcttggacaactggcctttattggagcaatggttttcagagccagaaaatattttgataaaaatcaatgctgaaatagataaggaatctttatgtgaaaaagtaaaagaaattcttacgactgaaatagcaaaaaaaaagaataaagttgagaagaaattagaagaaaaggaagctgagaaaaaagcagcagcttccctggctgagcttccacttcctacacctcctcctgctcctcctcctgaaccagaaaaagagaaggaaattcatcaaagccatgtggcttcaaaaactcctactgcaaaaggaaaacctcaatcaggtgattgacagaatgatttataatcctgttttcagtttcttatttttactcagtaaagaattataaattatagtctatctacattcagactttgggcaacttcaatcatatgaaacaaggctttacactcagatggaagtggaaaagccctcggagtagctaaaagcgtagttgttacaaagcccaacttctttgccatgtaggaggagacatggagtcatcacacctaggtctactgattagagtaagaccacagacgagaagaggaaaaggcacagagtaacaggtaacttcaggcagatcaagaggatacacgtctgtgtgctgaactatagagttacatttatgtaatgagtaagaacatcttaataaaataagaatgagtatagctggttttccaccagaataagggaacaaattaacagcaaccattagaactagaatttatatgtaattgtaaatcttcaggactatgtgattataaaagtatagaaacaagctcctgccatctcagtaaacatatatttatggacacagagataaagagcctagatagagaacacttttagtttaagtttgttctagatccttaaccgctatggaccataagtctagcattaagtggcagacaatgaatataatgacaaaagtgaagtgcttaattgttgtaatgcatgatattggtagagtgtcagtatccatttgtgtgtgtatataaaacaaatgaggctctggtttctagtttcagctttataaatggctgactgtgcagttacaccatgtctacctaagtatctttgatactgtgtcatgaccacatttctaaactctatagtctttctgcctcacggagatttgagataggtcttaatttttaaaattaaacttattcatattaaacaaagacatatgaagactttagtaagatatattatgatatattaaagaccattctgctccaggaaattagaaattaactacaggcaaaatacacacatcctaaaaaatgtttttatcatgtcaacaataaaacacaaagacatgaattaaacatacacccttttcccgctgtctcattaggaaattaaaaaacaattcagaggtctggaggaaaatggaaatatttaaaatgctttttagaactggggaagacaggccaagcatggtggctcatccctgtaatcccagcactttgggaggctgaggtgggcagatcaccagaaatcaggagttcgagaccccgctggccaacagggcaaaacccatctctaccaaaaatacaaaaattagctgggcgtggtggcaggcacctgtaatcccagctgcttgggaggctgaggcaggagaattgcttgaacctgagaggcggaggttgcagtgagccgagattgccccactgcactctagcctgggggatagagtgaaactctacctccaaaaaaaagaaaagaaaaataactgaggaagacagttttcacagtgggtcaggtgagcctagaattatcgaatatcgtcctttaacctatagctatgactctaggttaaagctcctcctcagcttgctccagtcaagagtatctatgtatttgagccatttcctgaaaccagactctagtgtttctgatcagaccagctcagtctttaagtttctgaagtttgtttgctattttataattatattcttgaatactgtgcattgaagaaataataaatctattgttgctttaaa

SEQ ID NO: 185561 - DNA, 1500 bp, Homo sapiens
  Payload ID: 16540
  Gene Symbol: SPEF2
  Gene Name: sperm flagellar 2
  ENST ID: ENST00000504054
  CDS Start-End: 335-1500
gcaatctcggctggctgcaagctccgcctccctcccagtagccaggactacaggcctacaggcgcccgccaccacacccggctaattttctgtatttttagtagagacaggctttcaacgtgttagccaggattcttatttgtagtaatcaagcacactgattctaacttaacagagcagaacatcaatgtattagttttcaaagagggctctatttgccctaggtccgtggttaccaagaaacaaggctattttctaattgttgtaggccaaggatttcagagggcttgataggggtctgggacttgtgtctatggaatagcaggaatagaagatgaacttgggtcatgtgaagggtatttggcttcaaattattaacactggagacaagaacatggttggagagtgggccttaccagaagaaatggttgacaatttaccaccctccaacaattgcatactgggccatattcttcacaggctagctgaaaaatctcttcctcctcgagcggaatcaacaacacctgaattaccttcatttgctgttaaaggatgcttattggggaaaacattaagtggaaaaactaccattttaaggtctctacaaaaagactttcctatacagatactttctattgacactcttgtccaagaagctatccaagcatttcatgacaatgaaaaagtcagtgaggttctaccaattcagaaaaatgatgaagaagatgctctaccagttctgcaagaggagattaaagaaagccaggatccacaacatgtattttcagctggtccagtttcagatgaagtattaccagaaacagaaggtgctaatgctgataaaacaccaaaagctgaagaagtcaaatcaagtgatagtttcttaaaactcactacacgtgctcagcttggtgcaaaatcagaacagttgctgaagaaaggaaagagcattcctgatgtgctgcttgttgacatcatagtaaatgctattaatgagatacctgtgaatcaagactgtatcctagatggttttccaatgactttaaaccaagcacagcttctggaagaagctcttacaggctgcaatagaaacctcacagaagtggaaagaaaaaaagcacaaaaatccacattggctattgatcctgcgacttccaaagaaatacctcttccctctcctgcatttgattttgtcatattattagatgtttcagatacttcctcaatgagtcgcatgaatgatattatagctgaagaattgtcctataaaactgctcacgaagatatcagtcaacgtgtagctgctgaaaaccaagataaggatggagaccaaaatttaagagaccagatacaacatagaattataggcttcttggacaactggcctttattggagcaatggttttcagagccagaaaatattttgataaaaatcaatgctgaaatagataaggaatctttatgtgaaaaagtaaaagaaattcttacgactgaaatagc

SEQ ID NO: 185562 - DNA, 381 bp, Homo sapiens
  Payload ID: 16540
  Gene Symbol: SPEF2
  Gene Name: sperm flagellar 2
  ENST ID: ENST00000506759
  CDS Start-End: 1-363
cccaaaccaaaaacaaaatcagtactgaagggcaagatggataactccctagaaaacgttgagtccaactttgaggccgatgaaaagttggtcatggacacctggcagcaggcttctttagcagtatctcacatggtcctgggtctaccaagatgtcttctcttttcacaacatgccaagccttcttcgagtttccatgaaatatcgcattcaaacagaaagcagcatcaactttccaaaagattttgtgaaagtggtagaagaggaccttgcagcacagatctcacagcaaacaaaatttccaactgggcactttccaagtcccttcttggcctctctgccttcaggcttctttttctctgaccttctcatacaagcagc

SEQ ID NO: 185563 - DNA, 2142 bp, Homo sapiens
  Payload ID: 16540
  Gene Symbol: SPEF2
  Gene Name: sperm flagellar 2
  ENST ID: ENST00000513078
  CDS Start-End: 1-346
aattcagaatgaactttatttaagccaagaagacttcttcattaatggcaatataaaagtcttcccagatcctcccccatcaatacgtcctccacctgtagaaaaggaagaagatggtaccctgaccattgaacagcttgacagtcttcgagatcagttcttagatatggcacctaaagagtgctctgagaactgctttcaaaggccttcaccttcgacctgtgatgccttctcaaataggagacaggaagtggcttcatggattacaggcagccctccagaactttctcaagggatatcctgcaattgttcggcaactgcactcagcaggcagaggcaaaagtgacaccagtcaaaagaaacccaaagaacttctggagtcccttctccaagctgacattgttaaatttgcccacttcttgttggatgtcatgaatgtccttagcattctgtcctgtgtcaataagaatagaaattcctcaattgctgacatatttgccactttagagtcaatgctggaaatgctccaaatgtatcaaacaagactagggccaaaagaacgcatggtggattcagccacacactttcatggtaactgcctcagagggaaagaaaacatttctgctgtgagaaacattgttttaacacatcttatcaagagacttcaaggctgtttcagagatgccagccaaaatgtggtgagggctaccgtgattggaagttttaaattgtggcccacaaagataaatcaagaatttggagaaaaagaggtatccatcctgactgcacattatgaaccagtattagaagctgccaatgtgaaacttagtgaagtggatactgaatggagcatgttgaaattagagatttatgccagatttcagaacattcgaaaattgacctgggattttgtgaattccatttacttacacaagtatccaaatatcctgacactagtcgacctagtgttgacccttcctgcaagttcagctgaagcagaacatggctttagtcagatgaaatggaccaagtcacatatgcatgcaaaaatcaaggctgaaagcataataggaaataaagcatttactgacattctgatcgatttggtgaccctgaaccttggcacaaacaactttcctagtaattggatgcaccttacccaacctgaattacaggaattaacatctttattaacagtcaactccgagttcgtggactggcggaagttcctgttagtaacctcaatgccttggcccattcccttggaggaggagctccttgagacccttcagaagttcaaggctgtggataaggagcagttgggcaccatcacttttgagcagtatatgcaggctggtctgtggtttacaggagatgaagatataaaaattccagaaaatcctcttgaaccccttccatttaataggcaggagcatcttatagagtttttctttaggctatttgctgactatgagaaggatccaccccagcttgactacacacagatgctgctttactttgcttgccacccagacaccgtggaaggagtctacagggccctcagtgtggctgttggaactcatgtcttccaacaagtcaaagcttccattccaagtgcagaaaagacctcctcaactgatgcaggtccagctgaggaatttcctgaacctgaggaaaatgctgcaagagaagaaaggaaattaaaagacgacacggagaaaagggaacagaaggatgaagaaatccctgaaaatgcaaacaatgaaaagatgtccatggaaacactactcaaagtgttcaaagggggaagtgaagcacaggactccaatagatttgccagccacctaaagatagagaacatttatgcagagggcttcataaaaacatttcaagacctaggtgccaagaacctggagccaattgaagtcgctgttctcttgaagcatccttttattcaagacctgatttcaaattattcagactataagtttcctgatattaaaataattctccaaaggagtgaacatgtacaaggaagtgatggagagagatcaccttcaagacatacagaggaaaagaaatgaagacaaaagagtgtgatttttttaattctgcaataaatcttccaaaaattaaatgtga

SEQ ID NO: 185564 - DNA, 671 bp, Homo sapiens
  Payload ID: 16540
  Gene Symbol: SPEF2
  Gene Name: sperm flagellar 2
  ENST ID: ENST00000505847
  CDS Start-End: 110-547
gcttccatagcaaagggttgcccttggctacaggaggacgcgggctggcaggcttggttcctggcgagtttctaagcccccgcctgcggtctgaggcaccggctgaaccatgtcggagatcctgtgccagtggctcaacaaggagttgaaggtgtcccggaccgtgagtcccaagtcatttgcaaaggcattttccagtggctatctacttggagaagttctacacaagtttgaacttcaggatgatttttcagaatttttggacagcagggtttcaagtgccaaacttaataatttttctcgcttggagccaacacttaaccttctgggtgtgcagtttgatcagaatgtggcccatggcatcatcacagaaaagcctggggtggcaacaaagctgttatatcaattgtacattgctcttcagaaaaagaagaaaagtggactgactggagtggagatgcaaaccatgcaacgtctgacaaatttaagacttcaaaacatgaaaagtgatacttttcaagagagactggggccacttatcagttgagaaaaagagtcagtggcaggagagatgaaaatggtacaaggacaagatggaaagaggccctctggggacggaaagaggaatatgcaatcaatggttcatgtggaagaggtgatatcataggaaa

SEQ ID NO: 185565 - DNA, 800 bp, Homo sapiens
  Payload ID: 16540
  Gene Symbol: SPEF2
  Gene Name: sperm flagellar 2
  ENST ID: ENST00000510777
  CDS Start-End: 79-800
aggaggacgcgggctggcaggcttggttcctggcgagtttctaagcccccgcctgcggtctgaggcaccggctgaaccatgtcggagatcctgtgccagtggctcaacaaggagttgaaggtgtcccggaccgtgagtcccaagtcatttgcaaaggcattttccagtggctatctacttggagaagttctacacaagtttgaacttcaggatgatttttcagaatttttggacagcagggtttcaagtgccaaacttaataatttttctcgcttggagccaacacttaaccttctgggtgtgcagtttgatcagaatgtggcccatggcatcatcacagaaaagcctggggtggcaacaaagctgttatatcaattgtacattgctcttcagaaaaagaagaaaagtggactgactggagtggagatgcaaaccatgcaacgtctgacaaatttaagacttcaaaacatgaaaagtgatacttttcaagagcaatacttaaacagaagacgacaaaatgaaataatggccaaaatccaagcagctattatacagattcctaaacctgcatcaaatcgtactttgaaagcactcgaggcccaaaaaatgatgaaaaagaaaaaagaggcagaagatgtggctgatgaaattaagaagttcgaagcattaataaaaaaggatctccaagcaaaagaaagtgcatccaagacttctttagatacagcaggccagacaaccaccgatttgttaaatacttactcagatgacgagtacattaaaaaaatccagaagcgccttga

SEQ ID NO: 185566 - DNA, 3146 bp, Homo sapiens
  Payload ID: 16540
  Gene Symbol: SPEF2
  Gene Name: sperm flagellar 2
  ENST ID: ENST00000506526
  CDS Start-End: 1-455
aagaacaccttgctgccttgcaatttgaagaaatagccacgcaatttcgacttgaactgataaagacaaaagcattggctcttcttgaagatttagtaacaaaggtggttgatgtatataaactcatggaaaaatggcttggtgagaggtatttgaatgaaatggccagtacagaaaaattaactgacgtagctcgctatcacattgaaacatctacaaaaattcagaatgaactttatttaagccaagaagacttcttcattaatggcaatataaaagtcttcccagatcctcccccatcaatacgtcctccacctgtagaaaaggaagaagatggtaccctgaccattgaacagcttgacagtcttcgagatcagttcttagatatggcacctaaaggactgaatttctcaatgcacatcatctcagcgaggctcatgccaaggcctcattaatggaagcaacaagtagctctccagtgaacagagccaccaccaaactaatgatgaggaccatgagcaaagtaaccctcgggagagtagagaacttattcagatcatgccatgctattgccaagaccggacgtcccctcaaagattttatttggatgtgcaaattagatgatatgaaaggtgttgatattggcccagtattcagaactaaaaaatcagcaagaatgtttacatactttattgctgaagtagaacgaaaaaatctaagagagaaattagaaaaaagtaaatttttctctgtcatcagtgatggaatcatagacagtttaatcaaagaagccgaacttgtctatgtgcagtttgcacatgcaggaaaggtgcactgtcaaattgttggggtacagatagtagaaagaaatgatcctctggcaataaaaaatgccattgagaaaactctagagataaatcttcaacttagactgtcgagccaagactgggcaaagaagctggttggttttggaagtgatggtacccatagcatagagggagagaacaacgaggtggccctactattaagagaaatacaaccatgtgtacaaactgtatattgctttgcacatcaccttgaactatcttacaaagcggtgttccagaacattcctctgtacaatgatgtcaaagacctccttcacagcatttatcacttttatcacaattctcctcttcataagagtgctctgagaactgctttcaaaggccttcaccttcgacctgtgatgccttctcaaataggagacaggaagtggcttcatggattacaggcagccctccagaactttctcaagggatatcctgcaattgttcggcaactgcactcagcaggcagaggcaaaagtgacaccagtcaaaagaaacccaaagaacttctggagtcccttctccaagctgacattgttaaatttgcccacttcttgttggatgtcatgaatgtccttagcattctgtcctgtgtcaataagaatagaaattcctcaattgctgacatatttgccactttagagtcaatgctggaaatgctccaaatgtatcaaacaagactagggccaaaagaacgcatggtggattcagccacacactttcatggtaactgcctcagagggaaagaaaacatttctgctgtgagaaacattgttttaacacatcttatcaagagacttcaaggctgtttcagagatgccagccaaaatgtggtgagggctaccgtgattggaagttttaaattgtggcccacaaagataaatcaagaatttggagaaaaagaggtatccatcctgactgcacattatgaaccagtattagaagctgccaatgtgaaacttagtgaagtggatactgaatggagcatgttgaaattagagatttatgccagatttcagaacattcgaaaattgacctgggattttgtgaattccatttacttacacaagtatccaaatatcctgacactagtcgacctagtgttgacccttcctgcaagttcagctgaagcagaacatggctttagtcagatgaaatggaccaagtcacatatgcatgcaaaaatcaaggctgaaagcataataggaaataaagcatttactgacattctgatcgatttggtgaccctgaaccttggcacaaacaactttcctagtaattggatgcaccttacccaacctgaattacaggaattaacatctttattaacagtcaactccgagttcgtggactggcggaagttcctgttagtaacctcaatgccttggcccattcccttggaggaggagctccttgagacccttcagaagttcaaggctgtggataaggagcagttgggcaccatcacttttgagcagtatatgcaggctggtctgtggtttacaggagatgaagatataaaaattccagaaaatcctcttgaaccccttccatttaataggcaggagcatcttatagagtttttctttaggctatttgctgactatgagaaggatccaccccagcttgactacacacagatgctgctttactttgcttgccacccagacaccgtggaaggagtctacagggccctcagtgtggctgttggaactcatgtcttccaacaagtcaaagcttccattccaagtgcagaaaagacctcctcaactgatgcaggtccagctgaggaatttcctgaacctgaggaaaatgctgcaagagaagaaaggaaattaaaagacgacacggagaaaagggaacagaaggatgaagaaatccctgaaaatgcaaacaatgaaaagatgtccatggaaacactactcaaagtgttcaaagggggaagtgaagcacaggactccaatagatttgccagccacctaaagatagagaacatttatgcagagggcttcataaaaacatttcaagacctaggtgccaagaacctggagccaattgaagtcgctgttctcttgaagcatccttttattcaagacctgatttcaaattattcagactataagtttcctgatattaaaataattctccaaaggagtgaacatgtacaaggaagtgatggagagagatcaccttcaagacatacagaggaaaagaaatgaagacaaaagagtgtgatttttttaattctgcaataaatcttccaaaaattaaatgtga

SEQ ID NO: 185567 - DNA, 775 bp, Homo sapiens
  Payload ID: 16541
  Gene Symbol: SMCP
  Gene Name: sperm mitochondria-associated cysteine-rich protein
  Uniprot ID: P49901
  ENST ID: ENST00000368765
  CDS Start-End: 151-501
ggttcagaaggctttggcttctgatagtcatggactcactaggctgctgaggaagatcaataatacctactggaatcagtcatgagaagtcaagcatggaaattgtgaattgtgtgtgtggccagaccagtacctccaagtgttcagaagatgtgtgaccagacaaaacacagtaaatgctgcccagcaaaaggcaatcaatgctgcccaccacagcagaaccagtgctgccagtcaaaaggcaatcaatgctgcccaccaaaacagaaccagtgctgccagccaaaaggcagtcaatgctgcccaccaaaacacaatcactgctgccagccaaaacccccatgctgcattcaggccaggtgctgtggtttggagaccaagcctgaagtctcaccccttaacatggagtctgagcccaactcaccgcaaactcaggacaagggctgtcaaacccagcagcagccccatagcccacaaaatgagtccaggccaagcaaatgagagcagaagaagtcaaacaaagaagaagtccctggggccatgcctttcactttgtagggtgggggattactgagagtcaggctagacctgtgtttagagaagcagttttcacagtgactaccatttccacccaatgagaggctcctatttcccatcatagctccctaccctagggaggcctccatctggaaatgggaggatgaagaggctagaatcatctttcctagtgatcctgacatttagacagcacagaaataaagagcaataaaaagaa

SEQ ID NO: 185568 - DNA, 691 bp, Homo sapiens; identical to SEQ ID NO: 185156
  Payload ID: 16542
  Gene Symbol: SPANXA1
  Gene Name: sperm protein associated with the nucleus, X-linked, family member A1
  Uniprot ID: Q9NS26
  ENST ID: ENST00000370519
  CDS Start-End: 334-627

SEQ ID NO: 185569 - DNA, 386 bp, Homo sapiens
  Payload ID: 16542
  Gene Symbol: SPANXA1
  Gene Name: sperm protein associated with the nucleus, X-linked, family member A1
  Uniprot ID: Q9NS26
  ENST ID: ENST00000615379
  CDS Start-End: 40-333
caaaagcctgccgctgacattgaagaaccaatatatacaatggacaaacaatccagtgccggcggggtgaagaggagcgtcccctgtgattccaacgaggccaacgagatgatgccggagaccccaactggggactcagacccgcaacctgctcctaaaaaaatgaaaacatctgagtcctcgaccatactagtggttcgctacaggaggaactttaaaagaacatctccagaggaactgctgaatgaccacgcccgagagaacagaatcaaccccctccaaatggaggaggaggaattcatggaaataatggttgaaatacctgcaaagtagcaagaagctacatctctcaaccttgggcaatgaaaataaagtttgagaagctg

SEQ ID NO: 185570 - DNA, 4965 bp, Homo sapiens
  Payload ID: 16543
  Gene Symbol: SSFA2
  Gene Name: sperm specific antigen 2
  Uniprot ID: P28290
  ENST ID: ENST00000320370
  CDS Start-End: 113-3883
agctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggaggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcagtatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 185571 - DNA, 3610 bp, Homo sapiens
  Payload ID: 16543
  Gene Symbol: SSFA2
  Gene Name: sperm specific antigen 2
  ENST ID: ENST00000409136
  CDS Start-End: 113-2419
gaatccatccctttcacttttaacttgcaacaacaacaacaacaaaaatgtgtgatctttggatttacaaaacttttgagctttagagaaagggaaagaggaagaagtgaaaatgaccactgaagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcagtatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 185572 - DNA, 4987 bp, Homo sapiens
  Payload ID: 16543
  Gene Symbol: SSFA2
  Gene Name: sperm specific antigen 2
  ENST ID: ENST00000409001
  CDS Start-End: 83-3796
gctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatggtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcagtatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 185573 - DNA, 747 bp, Homo sapiens
  Payload ID: 16543
  Gene Symbol: SSFA2
  Gene Name: sperm specific antigen 2
  ENST ID: ENST00000451836
  CDS Start-End: 1-606
ggcagtagaagcgctgataacttgtcatgcccttctccattgaatgtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggaggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatt

SEQ ID NO: 185574 - DNA, 5150 bp, Homo sapiens
  Payload ID: 16543
  Gene Symbol: SSFA2
  Gene Name: sperm specific antigen 2
  Uniprot ID: P28290
  ENST ID: ENST00000431877
  CDS Start-End: 180-3959
ctccccttccttccctccctccctccctgtcccctcctcctcctcctcctcctccggcgcccgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcagtatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 185575 - DNA, 3772 bp, Homo sapiens
  Payload ID: 16543
  Gene Symbol: SSFA2
  Gene Name: sperm specific antigen 2
  ENST ID: ENST00000454579
  CDS Start-End: 144-284
acagaagcgacgacgcaggacgaggaggaggacgaggaggaggacctccccggcgcgcagctgccggcagcggggggaagaggaaacgtgcccaacgagaagatcgcgatatggctcaaggactgccggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatggtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaag

SEQ ID NO: 185576 - DNA, 5420 bp, Homo sapiens
  Payload ID: 16543
  Gene Symbol: SSFA2
  Gene Name: sperm specific antigen 2
  ENST ID: ENST00000440623
  CDS Start-End: 194-334
acagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacaggtatgagaaaaagtatgttatcattagcttttttcttttactgctctgagcactttttaattcacagagaagctaaggcacatcaagtatgaactacctcagctttattttctgacatgtctaaacttaatctgcatctgccttcgttttctatcttccctcctgtttcaagggagaagctgtaactaaccctgatcaaagtcgatttctctgctcacaagtctgtctcctttccaagaggagagatttttctcgttaagtatcctcccatttttagtctatcatccactgtctttgttttagtctagaatcttttgtcatttctattattaaaaaatcttccctcttaaagttctttctctctttctctctgctatttgaacatgttgactaccttttccttttccaagttttctccctgttggcttctgtggcaccacgttctcctggttctgctcgtagctctctgactaagctttccccttcacctactgaccctcgatgctgtgcacagagttagtctacttccactggactcaaagactggaactactccagaccagaaaataacaaatcagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcagtatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 185577 - DNA, 5067 bp, Homo sapiens
  Payload ID: 16543
  Gene Symbol: SSFA2
  Gene Name: sperm specific antigen 2
  ENST ID: ENST00000416081
  CDS Start-End: 419-559
ggtgtttgctttcgagcatatttttgctttctcaatttagattttcttaatattttgttcaaatattagagttagggtagtttgttttgttttgttgtggaaagtgattcatatgccagtttgcctcctctaaagacagacaagatattggctaccatgatattaatgccttgttttgatgaatcgactggaaccttattgaacactctttattacagaactcgtaccctttattggaagtgtcatagacccttctgaaatatgatgacatatatggaataacttctgtttaaagatgcacagaggcaaatacactgcttgaagtccttggaccccagatttacaatctagcttacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcagtatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 185578 - DNA, 1613 bp, Homo sapiens
  Payload ID: 16544
  Gene Symbol: SPERT
  Gene Name: spermatid associated
  Uniprot ID: Q8NA61
  ENST ID: ENST00000310521
  CDS Start-End: 81-1427
ctgcctgtcagatgcctcattcccacctgtgatgctcagagagaaaccatgagccctgaaaaacaccatattgttttgtgatgtcacctctggaatgttctgagtgttttggtgaccaacttctgcataggacctatacctggcaactcacattgcactcaaggccaaattatacaagaaaaagagataccagatctgaaagcctagaaattccaatcagtgtggttctacctcagaggggcacagccgaacccttcccgaggctccacaacttgtacagcacccctcgctgcgcgcagcaggccgccctgccccggctgagccgcaggatggcgagccagcactcctatccactgaaccgcttctcctccgtgcctttagaccccatggagcgccccatgtcccaggccgacctggagctggactacaacccgccgcgggtgcagctcagcgacgagatgttcgtgttccaggacgggcgctgggtaaatgagaactgccgcctgcagtctccctacttctccccatccgcctccttccaccacaagctgcaccacaagaggctggccaaggagtgcatgctgcaggaggagaacaagtctctgcgggaggagaacaaggccctgcgcgaggagaaccggatgctcagcaaggagaacaagatcctacaggtcttctgggaggagcacaaggcctcgctgggccgagaggagagccgggccccctcgccactgctgcacaaagacagcgcgtccctggaggtggtgaagaaggaccacgtcgccctgcaggtgccccgtggcaaggaggacagcaccctgcagctcctccgggaggagaatcgcgcgctgcagcagctgctggagcagaaacaggcctactgggcgcaggcagaggacacggccgcccctgccgaggaaagcaagcccgccccctcaccccacgaggagccctgcagccccgggctgctgcaggaccagggctccggcctctcctcccgcttcgaggagcccaaagggcctccggcccggcaggaggactccaaggagctgcgcgccctgcggaagatggtcagcaacatgtccgggccctccggggaggaggaggccaaggtgggcccgggcctgcccgacggctgccagcccctgcagctgctgagagagatgaggcaggcgctgcaggccctgctcaaggagaaccggctcctgcaggaggagaacaggaccctgcaggtgctacgggcagagcacaggggcttccaggaggagaacaaggccctgtgggagaacaacaagctgaagctgcagcagaagctggtcattgacaccgtgaccgaggtcaccgcgcgcatggaaatgctcatcgaggagctctacgccttcatgccggccaggagccaggaccccaagaagcctagcagggtctgaggcctcggccttgcaccgggacgccgagtttgggacaccgaacactgggcaaaagagaatcccctgccttcctttgtcgtcctcgccttccccagccagttcgtacctattgaaaagcagcgttagcagccttcctaaactcagagttttaataaaggtgtgaggaggctggggccagttgacacc

SEQ ID NO: 185579 - DNA, 1842 bp, Homo sapiens
  Payload ID: 16544
  Gene Symbol: SPERT
  Gene Name: spermatid associated
  Uniprot ID: Q8NA61
  ENST ID: ENST00000378966
  CDS Start-End: 417-1655
gaagtaacccagccttctcaaaacgagatcttttggtgcttagtgttgtgcaatcactctggatttctgggggagaattagaactgggacttgaaatcaaatgcataagaatgaatccatgagaagaaaacctcatccgtggacaaaggggtacagagttatttggagctgtcaagagaattaagccctgctatgcatcaaagacagatgtaggggccatgggcatagatgctttttcagtcaatgaattggtgaagtcctcacaggctatagagtctcaggtctcctcctgcctgcaatcagctgtttccttagtggagtcctcttgattgaattgtttctactgctgctatgtcacaaaggggtggctttgctttctccagagtcacctaagtcctcattggaagaccagggccatgcaaccagaggggttgaaatgtaggatggaggaatccaatgcagagaggggcacagccgaacccttcccgaggctccacaacttgtacagcacccctcgctgcgcgcagcaggccgccctgccccggctgagccgcaggatggcgagccagcactcctatccactgaaccgcttctcctccgtgcctttagaccccatggagcgccccatgtcccaggccgacctggagctggactacaacccgccgcgggtgcagctcagcgacgagatgttcgtgttccaggacgggcgctgggtaaatgagaactgccgcctgcagtctccctacttctccccatccgcctccttccaccacaagctgcaccacaagaggctggccaaggagtgcatgctgcaggaggagaacaagtctctgcgggaggagaacaaggccctgcgcgaggagaaccggatgctcagcaaggagaacaagatcctacaggtcttctgggaggagcacaaggcctcgctgggccgagaggagagccgggccccctcgccactgctgcacaaagacagcgcgtccctggaggtggtgaagaaggaccacgtcgccctgcaggtgccccgtggcaaggaggacagcaccctgcagctcctccgggaggagaatcgcgcgctgcagcagctgctggagcagaaacaggcctactgggcgcaggcagaggacacggccgcccctgccgaggaaagcaagcccgccccctcaccccacgaggagccctgcagccccgggctgctgcaggaccagggctccggcctctcctcccgcttcgaggagcccaaagggcctccggcccggcaggaggactccaaggagctgcgcgccctgcggaagatggtcagcaacatgtccgggccctccggggaggaggaggccaaggtgggcccgggcctgcccgacggctgccagcccctgcagctgctgagagagatgaggcaggcgctgcaggccctgctcaaggagaaccggctcctgcaggaggagaacaggaccctgcaggtgctacgggcagagcacaggggcttccaggaggagaacaaggccctgtgggagaacaacaagctgaagctgcagcagaagctggtcattgacaccgtgaccgaggtcaccgcgcgcatggaaatgctcatcgaggagctctacgccttcatgccggccaggagccaggaccccaagaagcctagcagggtctgaggcctcggccttgcaccgggacgccgagtttgggacaccgaacactgggcaaaagagaatcccctgccttcctttgtcgtcctcgccttccccagccagttcgtacctattgaaaagcagcgttagcagccttcctaaactcagagttttaataaaggtgtgaggaggctggggccagttgacacca

SEQ ID NO: 185580 - DNA, 551 bp, Homo sapiens
  Payload ID: 16544
  Gene Symbol: SPERT
  Gene Name: spermatid associated
  ENST ID: ENST00000533564
  CDS Start-End: 72-551
agatgcctcattcccacctgtgatgctcagagagaaaccatgagccctgaaaaacaccatattgttttgtgatgtcacctctggaatgttctgagtgttttggtgaccaacttctgcataggacctatacctggcaactcacattgaggggcacagccgaacccttcccgaggctccacaacttgtacagcacccctcgctgcgcgcagcaggccgccctgccccggctgagccgcaggatggcgagccagcactcctatccactgaaccgcttctcctccgtgcctttagaccccatggagcgccccatgtcccaggccgacctggagctggactacaacccgccgcgggtgcagctcagcgacgagatgttcgtgttccaggacgggcgctgggtaaatgagaactgccgcctgcagtctccctacttctccccatccgcctccttccaccacaagctgcaccacaagaggctggccaaggagtgcatgctgcaggaggagaacaagtctctgcgggaggagaacaaggccctgcgcgaggagaaccgg

SEQ ID NO: 185581 - DNA, 1505 bp, Homo sapiens
  Payload ID: 16544
  Gene Symbol: SPERT
  Gene Name: spermatid associated
  Uniprot ID: Q8NA61
  ENST ID: ENST00000610924
  CDS Start-End: 81-1319
tggctttttacttgagatagaaataatcatcttagacagggaagcagagtcacctaagtcctcattggaagaccagggccatgcaaccagaggggttgaaatgtaggatggaggaatccaatgcagagaggggcacagccgaacccttcccgaggctccacaacttgtacagcacccctcgctgcgcgcagcaggccgccctgccccggctgagccgcaggatggcgagccagcactcctatccactgaaccgcttctcctccgtgcctttagaccccatggagcgccccatgtcccaggccgacctggagctggactacaacccgccgcgggtgcagctcagcgacgagatgttcgtgttccaggacgggcgctgggtaaatgagaactgccgcctgcagtctccctacttctccccatccgcctccttccaccacaagctgcaccacaagaggctggccaaggagtgcatgctgcaggaggagaacaagtctctgcgggaggagaacaaggccctgcgcgaggagaaccggatgctcagcaaggagaacaagatcctacaggtcttctgggaggagcacaaggcctcgctgggccgagaggagagccgggccccctcgccactgctgcacaaagacagcgcgtccctggaggtggtgaagaaggaccacgtcgccctgcaggtgccccgtggcaaggaggacagcaccctgcagctcctccgggaggagaatcgcgcgctgcagcagctgctggagcagaaacaggcctactgggcgcaggcagaggacacggccgcccctgccgaggaaagcaagcccgccccctcaccccacgaggagccctgcagccccgggctgctgcaggaccagggctccggcctctcctcccgcttcgaggagcccaaagggcctccggcccggcaggaggactccaaggagctgcgcgccctgcggaagatggtcagcaacatgtccgggccctccggggaggaggaggccaaggtgggcccgggcctgcccgacggctgccagcccctgcagctgctgagagagatgaggcaggcgctgcaggccctgctcaaggagaaccggctcctgcaggaggagaacaggaccctgcaggtgctacgggcagagcacaggggcttccaggaggagaacaaggccctgtgggagaacaacaagctgaagctgcagcagaagctggtcattgacaccgtgaccgaggtcaccgcgcgcatggaaatgctcatcgaggagctctacgccttcatgccggccaggagccaggaccccaagaagcctagcagggtctgaggcctcggccttgcaccgggacgccgagtttgggacaccgaacactgggcaaaagagaatcccctgccttcctttgtcgtcctcgccttccccagccagttcgtacctattgaaaagcagcgttagcagccttcctaaactcagagttttaataaaggtgtgaggaggctggggccagttgacacc

SEQ ID NO: 185582 - DNA, 982 bp, Homo sapiens
  Payload ID: 16545
  Gene Symbol: SPEM1
  Gene Name: spermatid maturation 1
  Uniprot ID: Q8N4L4
  ENST ID: ENST00000323675
  CDS Start-End: 26-955
gggccccggtggtcctagggaccccatggccatggttgagcggccgaggcccgagtgggcctcgtatcacaactgcaacagcaacagctgccaggacctgggcaactctgtcctgttgctgctgggcctcatcatctgcattaacattagcatcaatatagtgaccctgctctggagccgattccgtggtgtcttataccaagtgttccatgataccatttgtgagaaagaagctcccaagtcatcattactcagaaagcagacccagccccctaagaagcagagttctcctgcagtccatcttcggtgcaccatggaccctgtgatgatgactgtgtccccgcccccagctcaccgccatcgccgtcgaggctctcccacacgctgtgctcactgcccagtagcttgggctcctgacactgatgacgagaagcctcatcagtacccagccatctgctcctaccactgggatgtccctgaggactgggaaggcttccaacacactcaggggacctgggttccctggtctcaggatgccccagagtcccctccccagaccatccgcttccagcctaccgtagaggaaaggcccctcaaaacaggcatatggtccgagctgggcctaagggcctatgtgtatcctgtgaaccccccacctcccagccctgaggctcctagccacaagaacggtggggagggggcggtgccagaggcagaggcggctcagtaccagcctgtcccagctcccaccctgggcccagcagtcatccctgaattttcccggcaccgctcctcaggccgaatagtgtatgatgcccgggacatgagacggcggcttcgggaactgacccgggaggtggaggccctgtccggctgctaccccctagcctctggatccagcactgccgaggagacaagcaagaattgggtgtaccgttccctaactgggaggtgactggaaaaaaataaaaaggagagagga

SEQ ID NO: 185583 - DNA, 3337 bp, Homo sapiens
  Payload ID: 16546
  Gene Symbol: STRBP
  Gene Name: spermatid perinuclear RNA binding protein
  Uniprot ID: Q96SI9
  ENST ID: ENST00000348403
  CDS Start-End: 431-2449
gcgccaccagggcagcagccgccgcagccgccgccgctgggcagaggagccggagacgcgagcgggcgaggtggcggcggcggcggagcgggagcgggtaccgggcgcgggcagagcgcggcggcgcggagacggggttttgccatgttgacctggctggtctcgaactcctgaacgcaagtgatccgcctgcctcagcctcccaaggtgctgggattacaggcacgagccactgtgcctggcctcaactgttgcttcttataaaggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggccagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacagagtactgcctggttcctgatgcagtcactgattcttagttgattgatatgtatttgccccagggcactttaatttgggctgtagttattttttttaatacaatagagacttttcatttaactttaactttgtaaatattgaagtgtgtaataaagccaataaaatatgggtttgaatattgttttagcttattatttttgatatgttttggtatcaaattacaaggaattgaaaactaataacttagccctagaagcccattcacttgtaagcaaagtgctaaaacaaagcaaaggtgattgttagtttgagccagtctactcactttgtaagccctttgtactcctgttgtacaagggccatccccatgataaaggttccattctgttatttgagcattgcttattaaaatgatggcactacccagagatggggaaggagaatgtgattatcctagtttatgaatttccaagtttttaaaaataataaattaatcaatcaatcac

SEQ ID NO: 185584 - DNA, 2990 bp, Homo sapiens
  Payload ID: 16546
  Gene Symbol: STRBP
  Gene Name: spermatid perinuclear RNA binding protein
  Uniprot ID: Q96SI9
  ENST ID: ENST00000360998
  CDS Start-End: 456-2432
ccggagccgcgagcgccaccagggcagcagccgccgcagccgccgccgctgggcagaggagccggagacgcgagcgggcgaggtggcggcggcggcggagcgggagcgggtaccgggcgcgggcagagcgcggcggcgcgggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgataaacaagaacaaaagaggcaagactgttcataaaaaattgagaatgttttagtttgcgatggacttcaaaacaaaatatttaccatgtactaacatataatttcatagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggccagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacagagtactgcctggttcctgatgcagtcactgattcttagttgattgatatgtatttgccccagggcactttaatttgggctgtagttattttttttaatacaatagagacttttcatttaactttaactttgtaaatattgaagtgtgtaataaagccaataaaatatgggtttgaa

SEQ ID NO: 185585 - DNA, 2751 bp, Homo sapiens
  Payload ID: 16546
  Gene Symbol: STRBP
  Gene Name: spermatid perinuclear RNA binding protein
  ENST ID: ENST00000407982
  CDS Start-End: 294-578
gcgccaccagggcagcagccgccgcagccgccgccgctgggcagaggagccggagacgcgagcgggcgaggtggcggcggcggcggagcgggagcgggtaccgggcgcgggcagagcgcggcggcgcgggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaagtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagctttacagttcaccattaactgtagaactataaaatgatttctgaagtgtcaagataaatgttaattctgaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggccagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaa

SEQ ID NO: 185586 - DNA, 6161 bp, Homo sapiens
  Payload ID: 16546
  Gene Symbol: STRBP
  Gene Name: spermatid perinuclear RNA binding protein
  Uniprot ID: Q96SI9
  ENST ID: ENST00000447404
  CDS Start-End: 177-2195
cttctcttgcaggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaaggatcaaggtggtcggacattgtgtggtgtaatgaggattggcctggttgcaaaaggcttgctgattaaagatgatatggacttggagctggttttaatgtgcaaagacaaacccacagagaccctgttaaatacagtcaaagataatcttcctattcagattcagaaactcacagaagagaaatatcaagtggaacaatgtgtaaatgaggcatctattataattcggaatacaaaagagcccacgctaactttgaaggtgatacttacctcacctctaattagggacgaattggagaagaaggatggagaaaatgtttcgatgaaagatcctccggacttattggacaggcagaaatgcctgaacgccttggcgtctcttcgacatgccaaatggtttcaggcaagggcaaatggattaaaatcatgtgtaattgtcctccgcattctgcgtgatttgtgcaacagagtccccacatgggcaccattgaaaggatggccactagaacttatatgtgaaaagtctataggtacttgtaatagacctttgggcgctggggaggccttgagacgagtaatggagtgtttggcatctggaatactacttcctgggggtcctggtcttcatgatccttgtgagcgagacccaacagatgctctgagctatatgaccatccagcaaaaagaagatattacccacagtgcacagcatgcactcagactatcagcctttggccagatttacaaagtgctggagatggacccccttccatctagtaagccttttcagaagtattcctggtcagttactgataaagaaggtgctgggtcttcagctctaaagaggccatttgaagatggattaggggatgataaagaccccaacaagaagatgaaacgaaacttaaggaaaattctggatagtaaagcaatagaccttatgaatgcactaatgaggctaaatcagatcaggcctgggcttcagtataagctcctatctcagtctggccccgttcatgccccagtcttcacaatgtctgtagatgtggatggcacaacatatgaagcctcaggaccatccaagaaaacagcaaaacttcacgtagcggtgaaggtattgcaggcaatgggatatccaacaggctttgatgcagatattgaatgtatgagttccgatgaaaaatcagataatgaaagtaaaaatgaaacagtgtcttcaaactcaagcaataatactggaaattctacaactgaaacctccagtaccttagaggtaagaactcagggccctatcctcacagcaagtggcaaaaaccctgtaatggagctcaatgaaaaaagaagaggtctcaagtatgaactcatctcagagactggtggaagccatgacaagcgctttgtaatggaggtagaagtagatggacagaaattcagaggcgcaggtccaaataagaaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggtttacccaagagaatggttctgttacccgttatgaaatttccaacatatcctgttccccactactcattcttttagcaaatgacagaagctaattcctattgaacaacaatacagtacaacacagaatgttagagaaaaagcctttttatcctgctttctttgaacacatacttgatcaaaattatttgtaaagaacatctttcctactttttgattttaacaaatgcaaatttagttctctaaaacttgaaaaaaaaaaaagaaaccagttctgtgaaaacggtacctcatttctggaaaataacttataccagcccttctgttctagggaaataaaagtctagcagttcaaagtttaagttttaagagacgtatcagattatgtaaaattaaatttgtgaaggatgtatagagtctcaaacactgatcacaaataaactgctttgttgtaacacagagtactgcctggttcctgatgcagtcactgattcttagttgattgatatgtatttgccccagggcactttaatttgggctgtagttattttttttaatacaatagagacttttcatttaactttaactttgtaaatattgaagtgtgtaataaagccaataaaatatgggtttgaatattgttttagcttattatttttgatatgttttggtatcaaattacaaggaattgaaaactaataacttagccctagaagcccattcacttgtaagcaaagtgctaaaacaaagcaaaggtgattgttagtttgagccagtctactcactttgtaagccctttgtactcctgttgtacaagggccatccccatgataaaggttccattctgttatttgagcattgcttattaaaatgatggcactacccagagatggggaaggagaatgtgattatcctagtttatgaatttccaagtttttaaaaataataaattaatcaatcaatcaccctctcttgttcttgtggccttcttcactctgtaagatattgtgttcactccctggcttttttcatgcagatagaagattagtgattttgctgggattcattgaagggtctcctttcctcttcaattacatcagaatctaaagcagcaacagggtccccataaaaacttgctcttcgattgtcccagttcttgttgagtgctgctgtgaaaagtgacaggtttcagccatgggtcagcatttctttttaagacacctgatgatgctggtggaaatggatcagtgggtaacattgtgctgttctgtaaagggtgcagacctaagtcctccacttgcattctcaccttgtttggaaagccaatgatgttactaggtcaatggtttcattaaggtactcacccccatgaaggagcagcagtgtggtcccctgtcaatatttataaggcaccatgtcttaaaaatgtctgtttttagtatgaattagctttcattttccctattcagttctgcttttgggaacttgacagggcccatccatgagaatgggcttcacaaaatatggcaaatgtatgtaccaaattccttcgggaccactaaataaaggtgaaatgggcaatgtacaacaaatgttagtgtcacttctcagatatatattacacaatgattagtttgtttcttctccttggtcttttgtctttattagtggtgggtgatactttaataaaacctcatcacttgctggaaatagctgtaacttatcattctcatcctgtgcattagtggctagacataaacaagagggcccatttcagctgggagttttcatgtttcattgatgcgttttgctgacctatggatgaaacagagccatcactgagaagaaaaagcatggctgatagtgtccagtttttattaattaaatctttacagtagtcctcattgtctttggaatactattaattggcagctgcggctgtattgttatttgaaattggtcatcaaatttggattccacgttggaatctctagatatttctcgttagaaaattcttttgaagtagctgactctgcttcataactcacgcgctctgtaatggtgaaaagggagctgtgctgttttccaacatgatggcagtcatttcaaatggtttctaccaagtcttttttttttttttttaattttgttgtttgttggaagttactaaccatgttgtaaacctgcccagttgctgcaaacttttacatttctctgctttacttaaaataatcgagctgtcagtcctttgttagaagtggtaaccatgcaagttcaactgtttaaattctgtaatgaattaagtgtccccccacctgttgcccttcccacccttccattttgtaatgaaaattccacttacagctgaaagagcagagaaatataaatgaagctcttggcttcaccaaattgcctgagattaacatgaagttttgcttctctgctcttttctccactgtaggtggttttttcattgacagcccctattgccagcctctgagcgtcgcaccatttattattcacttgggccctcaagatttcttctctgacttctagaaccatcaggttgtctggcttgaaatggcaatttctatgtcttggtcttaagagcaatgtgacaccctgaggctatccagctttcagacactccactctgacaccctctttttgaaagcaatgactgatcattttaaagaagagcaatactttgttcaaagccacggtgtctgttttaaaacttttcctttggaaacctagcaatatctgtacttaacccctttttagcatagtttcttgtcagggagtttacaggtcagtgtagagcttaaaattagcgtgtgagctgtgctatgttctgacagttttttacactttttagcacataaatagttacattcctgactgcgtcagttagcgttactataatttctcagagataggggtcctccttgaagccatatcctctgcacggggactggcccctagccagggatgtggcttgcagcttgtgtttcttcaggctgcaggagtaccccatctcttgtgcaaggtaattggtccagtagatttccaacatacctcatgctgactagatgaagtgcatgggtggtgaagtaaggagttgagtttatatagttctgaagtcgtttgtagtctctctcaaattgttagcctggggaacaaaccactgagagattttgctggtattggccttttctttttttttttttttttaattttgggtgaatgtttgaaaatcatgaatcagccaccattattaattgaagagctgggaatacctcgttaatgtatttttaaaactggtgttggaccctctgtgtatttcaggttaatacttttaagcagttttcagcacgtttatctcactttattctcgttctcctcggaccttcgtagccatatcacttgtataaaataggctgagatatagtgactgtaagctgtgatctcagtatacaaaggtaagctcttttattttctgattaaagagaaaaatagtcaattaagacaacatgcatatatgacaatcatatatgatgtatttgatctcttaggtcatatgtcatcgcattacctttaaaaattgtatggtctaaatgtaaaatagttatttttcaacatttgttttaatacccttgtaactgctttttactcaagacagacatttcacttacactaagtgtgtgtgtgtgtgtgtgtgtgtgtagaaacttaggatataacacgtatgtaaattacacacacatacctgtttaaatgtaagaattcagtgataggaacagttcatctaagaagattttaatgacagggcactcttttggccaaagcagtggaatttcctaagcagcaaggttggtaatagtgctggtaggatctgtatgtgtaagctgttacacaagctgaggatcaaagtgccaatttctcaaggagaaaaacttctccgagaaatgaaagtctctgatctgtgttgtatgccctaatacaacaacagcaagaagccatagaaaaaagcaatagaaaatg

SEQ ID NO: 185587 - DNA, 657 bp, Homo sapiens
  Payload ID: 16546
  Gene Symbol: STRBP
  Gene Name: spermatid perinuclear RNA binding protein
  ENST ID: ENST00000496533
  CDS Start-End: 1-270
aaagtggcaaaggcgagtgcagctttagctgccttggagaaactgttttctggacccaatgcggcaaataataagaaaaagaagattatccctcaggcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggttaatacttttaagcagttttcagcacgtttatctcactttattctcgttctcctcggaccttcgtagccatatcacttgtataaaataggctgagatatagtgactgtaagctgtgatctcagtatacaaagaaccaacttcagcaagactcgggtggtgaatatcgagtctgcagagaccaaatagacttaaagcaatccatctgtcttttccaggttaggtagctagattatttatttcccaccttattcaaccatcatggagttcatgtaaagatgtgagggttaggcagacattttaataaagatttgcttcatttaggtgtgtcccataaatgcatttaattgtgttagatgttgtgtgctaaggctgtatttgatatatgtaga

SEQ ID NO: 185588 - DNA, 832 bp, Homo sapiens
  Payload ID: 16546
  Gene Symbol: STRBP
  Gene Name: spermatid perinuclear RNA binding protein
  ENST ID: ENST00000479114
  CDS Start-End: 609-832
gctttgtcacgctggctggagtacagtggcgcaatctcggctcactgcaatctccgcctcccaggttcaagcaattctgcctcggcttcctgagtagctgggactacaggtgcgcaccaccatgcctggctaatttttgtatttttagtagcgtcggggtttcaccatgttggccaggctggtctcgaactcctgacctcaggtgatccacccgccttggctcctaaagtgctggaattacaggtatgagccactgtgactggccgcaggtggtctgattctagtcctggctctgtcgcagactagctgcttgatctcaggaaatgtctctatttctagattgtcttcaatgttcttatcctgcttatctgtggataatattcttgatagtcatgtgaaggatctatcttgggaaagccaaggacatctgggaatgtttgacaggtgtgttccagagaacaagccttcagacatttgctatattgacgctgagctgtcaggggactcaggcttatgaggaggtattgttacacaaaacagtgtctagtgaagacgacaagaaagaggggaaaggatcggaaaaagaagctaaaatactatagaaaaccatgagatctattcgatcttttgctaatgatgatcgccatgttatggtgaaacattcaacaatctatccatctccggaggaacttgaagctgttcagaatatggtatctactgttgaatgtgctcttaaacatgtctcagattggttggatgaaacaaataaaggcacaaaaacagagggtgagacagaagtgaagaaagatgaggccggagaaaactattccaa

SEQ ID NO: 185589 - DNA, 663 bp, Homo sapiens
  Payload ID: 16546
  Gene Symbol: STRBP
  Gene Name: spermatid perinuclear RNA binding protein
  ENST ID: ENST00000478973
  CDS Start-End: 1-174
gcaaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatggttaatacttttaagcagttttcagcacgtttatctcactttattctcgttctcctcggaccttcgtagccatatcacttgtataaaataggctgagatatagtgactgtaagctgtgatctcagtatacaaagggtgaaagacaattatgggaagccagtggggcaatttgagctaaaatacacctcccgcgatgacagacgcagccttgagagagcagctgaggtgcgacatgagctccctgtaaccagcatcgtgactgaagcagcagcctgcacatgtggatggtcatcagtgcctcgcccagagatacctggccttcatccaaagggaccctgctgccacaagtcctccaggcagcacccgcactgtggctccttcgcactgagtatgttggactctgccatagactgaccctcttgtctggctgctgcagtttgtctgtaatgccctgacatgttgcattctccccatttggataaataaaaacaaac

SEQ ID NO: 185590 - DNA, 535 bp, Homo sapiens
  Payload ID: 16546
  Gene Symbol: STRBP
  Gene Name: spermatid perinuclear RNA binding protein
  ENST ID: ENST00000471564
  CDS Start-End: 1-254
caaagggcgttgtgaatacagctgtgtctgcagcagtccaagctgttcggggcagaggaagaggaactctaacaaggggagcttttgttggggcgacagctgctcctggctacatagctccaggctatggaacaccatatggttacagcacagctgcccctgcctatgaggctacgttaaaggaatatggtagccatcatctgggaggtaaaaaacctatggaaattggcacctggggaactcaggaaagctgaaagcaccttgaaatgagatggaaggaccagaaggttaaggctggtgaagaggagacctggagagaacgtgggcactcctgccagcgtgactgaagcagcagcctgcacatgtggatggtcatcagtgcctcgcccagagatacctggccttcatccaaagggaccctgctgccacaagtcctccaggcagcacccgcactgtggctccttcgcactgagtatgttggactctgccatagactgaccctcttgtctggctgctgcagtttgtctgtaatgcc

SEQ ID NO: 185591 - DNA, 2007 bp, Homo sapiens
  Payload ID: 16547
  Gene Symbol: SPATC1
  Gene Name: spermatogenesis and centriole associated 1
  Uniprot ID: Q76KD6
  ENST ID: ENST00000377470
  CDS Start-End: 103-1878
agactctgcaccctccttcagcccaggcaaggcctggggccctgggcagcctccaggtgcagtgccctcccgtgggccgcacccttgccactgccccagggcatgtctctactcaccaattatgaagggcttcggcatcagatagagaggctggtgcgggaaaatgaggaactgaagaagttggtgcggctcattcgggagaatcacgagctcaagtcagcgatcaagactcaggcaggcgggctcggcatcagcgggttcacgagtgggcttggtgaggcaacagcaggcctttcctcacgccagaacaatggtgtcttcctgcccccgtccccagcagtggcaaacgaacgagtcctcgaagaagtggggatcatggccttggcacccctggccgagatgctaaccagcttgcagcccagcgccacaccgggctcactcatgagccccctgacaggcaccctcagcacgctgctgtctggcccagcacccacgtcacagagcagccccctcaccagcttcctgaccagtcccattgcgggacccctaacaggcacactggccagttccctgggcctgccctccactggcaccctgactcccagcagcctcgtggcaggccctgtggccatgtcccagagcagccccctgatagcccctgtgatgggcacggtggctgtctctctgagcagccccctcctcagctccactgccaccccaccaggggtctctcagaacctgctggccaaccccatgagcaacctggtcctgccagaggccccaaggctgcggctggctgagccactccgcggaggccccactgggccccagtccccagcttgcgtggtacccactgccaccaccaaagtcccactctccactgagcccccccagtcgacccaggacccagagcctctcagcatggcgtttgcaggagcacccctccagacctccacccctatcggagccatgggcacacctgctcccaagacggccttctccttcaacacttcggacacacaggcccagcccagtgccgcccaggaacaagtggtccctgcatctgtccccacctcccccaccacctcccccacggtcaccgtccttgcctctgcccccgcccttgccccccaggttgccaccagctacacaccctcaagcaccacccacatcgcccagggtgccccccatcccccttcccgaatgcataattccccaacccagaacctgcctgtcccccactgtcctccacacaacgcccactccccacctcgtacctcatcctccccggcttcagtcaatgactctcgaggtccacgcaccacagaaccgtcgacgaagagcatgatggaggtggaacggaagctggcccaccgcaagaccagcaagttccccgagaacccccgagagtcgaagcagctggcctgggagaggctggtgggtgagattgccttccagctggaccgcaggatcctgtccagcatcttcccagagcgcgtacggctctacggcttcactgtctccaacatcccagagaagatcatccaggcttccctgaaccccagtgaccacaagctggatgagaagctgtgccagaggctcacacagcgctatgtgagcgtcatgaacaggctgcagagtctgggctacaacgggcgggtgcaccctgcgctgaccgagcagctggtgaacgcttatggcatcctgcgagagcgcccggagctggcggcgtctgagggcggcccctacaccgtggacttcctgcagcgtgtggtggtggagaccgtgcaccccggcatgctcgccgacgcgctgctgctgctctcctgcctcagccagctggcgcacgatgacggcaagcccatgttcatctggtgacgctggagctgggaggtccaggctcgctcagccccacagccctgtgcacggccattaaagcttcccacagacactggtcgctgggcctgtgccagcgctcctgggtggtgctgcctcctctggggtggc

SEQ ID NO: 185592 - DNA, 1795 bp, Homo sapiens
  Payload ID: 16547
  Gene Symbol: SPATC1
  Gene Name: spermatogenesis and centriole associated 1
  Uniprot ID: Q76KD6
  ENST ID: ENST00000447830
  CDS Start-End: 91-1416
ctccttcagcccaggcaaggcctggggccctgggcagcctccaggtgcagtgccctcccgtgggccgcacccttgccactgccccagggcatgtctctactcaccaattatgaagggcttcggcatcagatagagaggctggtgcgggaaaatgaggaactgaagaagttggtgcggctcattcgggagaatcacgagctcaagtcagcgatcaagactcaggcaggcgggctcggcatcagcgggttcacgagtgggcttggtgaggcaacagcaggcctttcctcacgccagaacaatggtgtcttcctgcccccgtccccagcagtggcaaacgaacgagtcctcgaagaagtggggatcatggccttggcacccctggccgagatgctaaccagcttgcagcccagcgccacaccgggctcactcatgagccccctgacaggcaccctcagcacgctgctgtctggcccagcacccacgtcacagagcagccccctcaccagcttcctgaccagtcccattgcgggacccctaacaggcacactggccagttccctgggcctgccctccactggcaccctgactcccagcagcctcgtggcaggccctgtggccatgtcccagagcagccccctgatagcccctgtgatgggcacggtggctgtctctctgagcagccccctcctcagctccactgccaccccaccaggggtctctcagaacctgctggccaaccccatgagcaacctggtcctgccagaggccccaaggctgcggctggctgagccactccgcggaggccccactgggccccagtccccagcttgcgtggtacccactgccaccaccaaagtcccactctccactgagcccccccagtcgacccaggacccagagcctctcagcatggcgtttgcaggagcacccctccagacctccacccctatcggagccatgggcacacctgctcccaagacggccttctccttcaacacttcggacacacaggcccagcccagtgccgcccaggaacaagtggtccctgcatctgtccccacctcccccaccacctcccccacggtcaccgtccttgcctctgcccccgcccttgccccccaggttgccaccagctacacaccctcaagcaccacccacatcgcccagggtgccccccatcccccttcccgaatgcataattccccaacccagaacctgcctgtcccccactgtcctccacacaacgcccactccccacctcgtacctcatcctccccggcttcagtcaatgactctcgaggtccacgcaccacagaaccgtcgacgaagagcatgatggaggtggaacggaagctggcccaccgcaagaccagcaagttccccgagaacccccgaggcttccctgaaccccagtgaccacaagctggatgagaagctgtgccagaggctcacacagcgctatgtgagcgtcatgaacaggctgcagagtctgggctacaacgggcgggtgcaccctgcgctgaccgagcagctggtgaacgcttatggcatcctgcgagagcgcccggagctggcggcgtctgagggcggcccctacaccgtggacttcctgcagcgtgtggtggtggagaccgtgcaccccggcatgctcgccgacgcgctgctgctgctctcctgcctcagccagctggcgcacgatgacggcaagcccatgttcatctggtgacgctggagctgggaggtccaggctcgctcagccccacagccctgtgcacggccattaaagcttcccaca

SEQ ID NO: 185593 - DNA, 2303 bp, Homo sapiens
  Payload ID: 16548
  Gene Symbol: SPATC1L
  Gene Name: spermatogenesis and centriole associated 1-like
  Uniprot ID: Q9H0A9
  ENST ID: ENST00000291672
  CDS Start-End: 1063-2085
gtgctttctgccgtacgtcccttcccatgaggatgagatgacccatctgttgcatcccggctgctgataaaacaagaccctcggagccaagaaacaacactgaggctgatctccccgcccaggctggtctcccccgcaggctggtctcccccgcaagctggtctcctcccccaggctggtctcctcaccaggctggtctcctcccccaggctgatctccccgcccaggctggtctcccccgcaggctggtctcccccacaaggctggtctcctcccccaggctggtctcctcaccaggctggtctcctcccccaggctgatctccccgcccaggctggtctcccccgcaggctggtctcccccgcaagctggtctcccctgcaggctggtctcctccccaggctggtctcccccgcagactggtctcccccacaagctggtctccccaccaggctggtctcccccacatgctggtctcctcccactgcccttgccagtccctccctcctcaagtgtgggtgccaaggacggaccctgatgaacacctgcacatcagttgctgccctgggtgccagggtccacaggaagctgcactgggaaccctgtgtcctgggcaggtcctatgggaagtgcagcccacatgttactcgggtgaaggcagcgtccccacccagcttgaggacaccacacagggtggacacccgaccctggctgggccgctcaatggggagtggcttggacgcccctcttggagtacagtcgctacatcccgtagctgcctaatgtccttggcattctcgggccctggtcataatgtgggagtggctgcctgtgcacgccacgggcctccagcttcactgcctcaacggggccatgagccatcgcgggggcaggcagggtgctgggcacctcatcactagggcagtgacatcacaaggcgtggaaggcggtggtggctacggaactccgtgcctgggctgtttctgtggtgcctgcgggctctgggctcccacctccatggggctgcaggagccgtgagggacaaggagggacgcacccgccatggctgaaggcggcgagctgatgagccggctcctgagcgagaacgcggacctgaagaagcaggtgcgcctcctgaaggagaatcagatgctgcggcggctgctcagccagagctgccaggagggcggcggccacgacctgctcccacccagggcgcatgcctaccctgaggccggctcccccgggagcggagttccagatttcggaaggttcacgagtgttgccgacacgccctcccaactgcagacatcctccctggaggacctgctgtgctcacatgcccccctgtccagcgaggacgacacctccccgggctgtgcagccccctcccaggcacccttcaaggccttcctcagtcccccagagccacatagccaccgaggcaccgacaggaagctgtccccgctcctgagccccttgcaagactcactggtggacaagaccctgctggagcccagggagatggtccggcctaagaaggtgtgtttctcggagagcagcctgcccaccggggacaggaccaggaggagctactacctcaatgagatccagagcttcgcgggcgccgagaaggacgcgcgcgtggtgggcgagatcgccttccagctggaccgccgcatcctggcctacgtgttcccgggcgtgacgcggctctacggcttcacggtggccaacatccccgagaagatcgagcagacctccaccaagtctctggacggctccgtggacgagaggaagctgcgcgagctgacgcagcgctacctggccctgagcgcgcgcctggagaagctgggctacagccgcgacgtgcacccggcgttcagcgagttcctcatcaacacctacggaatcctgaagcagcggcccgacctgcgcgccaaccccctgcacagcagcccggccgcgctgcgcaagctggtcatcgacgtggtgccccccaagttcctgggcgactcgctgctgctgctcaactgcctgtgcgagctctccaaggaggacggcaagcccctcttcgcctggtgagccgccccgcgcccgccgccttgcctgcagtaaacgcgtttgttccaacccggggccgcggtgcctcctgcgcgtccccccggaggggaaagggccgcgtcccccgcgcgcgaggccagagaaggccccgctcccaccggtgctgggccccgaccgcagcccgccgctgcccgcacctgcggagtgcttctcacccctcattaaaatcatccgtttgc

SEQ ID NO: 185594 - DNA, 1182 bp, Homo sapiens
  Payload ID: 16548
  Gene Symbol: SPATC1L
  Gene Name: spermatogenesis and centriole associated 1-like
  Uniprot ID: Q9H0A9
  ENST ID: ENST00000330205
  CDS Start-End: 391-951
ggccggcccactgggttgtgctttctgccgtacgtcccttcccatgaggatgagatgacccatctgttgcatcccggctgctgataaaacaagaccctcggagccaagaaacaacactgagttccagatttcggaaggttcacgagtgttgccgacacgccctcccaactgcagacatcctccctggaggacctgctgtgctcacatgcccccctgtccagcgaggacgacacctccccgggctgtgcagccccctcccaggcacccttcaaggccttcctcagtcccccagagccacatagccaccgaggcaccgacaggaagctgtccccgctcctgagccccttgcaagactcactggtggacaagaccctgctggagcccagggagatggtccggcctaagaaggtgtgtttctcggagagcagcctgcccaccggggacaggaccaggaggagctactacctcaatgagatccagagcttcgcgggcgccgagaaggacgcgcgcgtggtgggcgagatcgccttccagctggaccgccgcatcctggcctacgtgttcccgggcgtgacgcggctctacggcttcacggtggccaacatccccgagaagatcgagcagacctccaccaagtctctggacggctccgtggacgagaggaagctgcgcgagctgacgcagcgctacctggccctgagcgcgcgcctggagaagctgggctacagccgcgacgtgcacccggcgttcagcgagttcctcatcaacacctacggaatcctgaagcagcggcccgacctgcgcgccaaccccctgcacagcagcccggccgcgctgcgcaagctggtcatcgacgtggtgccccccaagttcctgggcgactcgctgctgctgctcaactgcctgtgcgagctctccaaggaggacggcaagcccctcttcgcctggtgagccgccccgcgcccgccgccttgcctgcagtaaacgcgtttgttccaacccggggccgcggtgcctcctgcgcgtccccccggaggggaaagggccgcgtcccccgcgcgcgaggccagagaaggccccgctcccaccggtgctgggccccgaccgcagcccgccgctgcccgcacctgcggagtgcttctcacccctcattaaaatcatccgtttgcatgtctgccttta

SEQ ID NO: 185595 - DNA, 1182 bp, Homo sapiens; identical to SEQ ID NO: 185594
  Payload ID: 16548
  Gene Symbol: SPATC1L
  Gene Name: spermatogenesis and centriole associated 1-like
  Uniprot ID: Q9H0A9
  ENST ID: ENST00000618495
  CDS Start-End: 391-951

SEQ ID NO: 185596 - DNA, 2303 bp, Homo sapiens; identical to SEQ ID NO: 185593
  Payload ID: 16548
  Gene Symbol: SPATC1L
  Gene Name: spermatogenesis and centriole associated 1-like
  Uniprot ID: Q9H0A9
  ENST ID: ENST00000621926
  CDS Start-End: 1063-2085

SEQ ID NO: 185597 - DNA, 1987 bp, Homo sapiens
  Payload ID: 16549
  Gene Symbol: SOHLH1
  Gene Name: spermatogenesis and oogenesis specific basic helix-loop-helix 1
  Uniprot ID: Q5JUK2
  ENST ID: ENST00000298466
  CDS Start-End: 62-1048
gggggcggggctgcctgcggaaggggccgtgcgcgtggggtcgctccgcagctgcgagttcatggcgtcccggtgctccgagccctacccggaggtctccagaatccctaccgtcaggggatgcaacggctccctgtctggtgccctctcctgctgcgaggactcggcccggggctcgggcccgcccaaggcccctacggtggccgagggtcccagctcctgccttcggcggaacgtgatcagcgagagggagcgcaggaagcggatgtcgttgagctgtgagcgtctgcgggccctgctgccccagttcgatggccggcgggaggacatggcctcggtcctggagatgtctgtgcagttcctgcggcttgccagcgccctggggcccagtcaggagcagcacgctattcttgcttcctccaaggaaatgtggcactcgttgcaggaggatgttttacagttgacgttgtcgagtcagattcaagcaggtgtgccagaccctgggacgggagcgtccagcgggactcgaaccccagatgtgaaggcgtttctggaaagtccttggtccctggatccagcgtcggccagcccagagcccgtgccgcacatccttgcgtcctccaggcagtgggaccccgcgagctgcacgtccctgggcacggacaagtgtgaggcactgttggggctgtgccaggtgcggggtgggctgccccctttctcagaaccttccagcctggtgccgtggcccccaggccggagtcttcctaaggctgtgaggccacccctgtcctggcctccgttctcgcagcagcagaccttgcccgtgatgagcggggaggcccttggctggctgggccaggctgggcccctggccatgggggctgcacctctgggggagccagccaaggaggaccccatgctggcgcaggaggccgggtctgcgttggggtctgatgtggacgatgggacgtccttcctgctgactgctggtcccagctcgtggccgggtgagtggggccctgggttcagggctggtccccccgcgtaagcacctgatatgagctggggaattgggactcaggcctagcgtgtgtcagggggccccagggtctgtgtctgagcccccgttttctccaccgttggtgcttagctgttgggccgtgtctggtattgagcgttataggtgatatgtgagtgtgtgagtgaacgtgatgtggacgagcctgcatgagagctggcggtgcttggagccctgtattcttccccttgaccctgtgtcagcgaggcccctggtccagcccgtgctggccggcaaaggtgtatggccctgtgacatggcgtgtgtccattccatttaggatttagtgtttgggagcccgttcctggttctggtccaacaggtgtcctgggtctggggccaccaggtatgagctcacccacctcatcacagcctctgtgcagcggggacagggcagggcagacggactgaggtgggagctctgttcctccgaccccacctgtctgcctcaagctcccagagcacctgcctgccctgccgatgtgtcctgtttgcttccagggtctctggagggtcgaggaggcagtggccctgcatgggccccagctgagagcagtccactggatgttggagagccaggcttcctaggggaccctgagcttggctcccaggagctccaggacagccctctggagccgtggggcctggatgtggactgtgcaggcctggccctgaaggacgaggtggagagcatcttccctgacttctttgcctgctagcagccaggctgtggagaggaggcgggcggggccggtggatctggagccgtgtgtgtccctgtcgcgtgcttgggcattttattttgggtttgggttgcagctgcaccctaatttgagcgaggcttacaggctgtgagaagaggatagtgaatattaaagagggaaagcagttttcctggaggaagcaaaa

SEQ ID NO: 185598 - DNA, 1411 bp, Homo sapiens
  Payload ID: 16549
  Gene Symbol: SOHLH1
  Gene Name: spermatogenesis and oogenesis specific basic helix-loop-helix 1
  Uniprot ID: Q5JUK2
  ENST ID: ENST00000425225
  CDS Start-End: 62-1225
gggggcggggctgcctgcggaaggggccgtgcgcgtggggtcgctccgcagctgcgagttcatggcgtcccggtgctccgagccctacccggaggtctccagaatccctaccgtcaggggatgcaacggctccctgtctggtgccctctcctgctgcgaggactcggcccggggctcgggcccgcccaaggcccctacggtggccgagggtcccagctcctgccttcggcggaacgtgatcagcgagagggagcgcaggaagcggatgtcgttgagctgtgagcgtctgcgggccctgctgccccagttcgatggccggcgggaggacatggcctcggtcctggagatgtctgtgcagttcctgcggcttgccagcgccctggggcccagtcaggagcagcacgctattcttgcttcctccaaggaaatgtggcactcgttgcaggaggatgttttacagttgacgttgtcgagtcagattcaagcaggtgtgccagaccctgggacgggagcgtccagcgggactcgaaccccagatgtgaaggcgtttctggaaagtccttggtccctggatccagcgtcggccagcccagagcccgtgccgcacatccttgcgtcctccaggcagtgggaccccgcgagctgcacgtccctgggcacggacaagtgtgaggcactgttggggctgtgccaggtgcggggtgggctgccccctttctcagaaccttccagcctggtgccgtggcccccaggccggagtcttcctaaggctgtgaggccacccctgtcctggcctccgttctcgcagcagcagaccttgcccgtgatgagcggggaggcccttggctggctgggccaggctgggcccctggccatgggggctgcacctctgggggagccagccaaggaggaccccatgctggcgcaggaggccgggtctgcgttggggtctgatgtggacgatgggacgtccttcctgctgactgctggtcccagctcgtggccggggtctctggagggtcgaggaggcagtggccctgcatgggccccagctgagagcagtccactggatgttggagagccaggcttcctaggggaccctgagcttggctcccaggagctccaggacagccctctggagccgtggggcctggatgtggactgtgcaggcctggccctgaaggacgaggtggagagcatcttccctgacttctttgcctgctagcagccaggctgtggagaggaggcgggcggggccggtggatctggagccgtgtgtgtccctgtcgcgtgcttgggcattttattttgggtttgggttgcagctgcaccctaatttgagcgaggcttacaggctgtgagaagaggatagtgaatattaaagagggaaagcagttttcctggaggaagc

SEQ ID NO: 185599 - DNA, 1909 bp, Homo sapiens
  Payload ID: 16550
  Gene Symbol: SOHLH2
  Gene Name: spermatogenesis and oogenesis specific basic helix-loop-helix 2
  Uniprot ID: Q9NX45
  ENST ID: ENST00000317764
  CDS Start-End: 63-740
agcggctgtggagctcctcctgctgggaggctgccccaggacccagcacgtgcgcagcggccatggcttcctcaattatctgccaggagcactgccagatctcgggccaggcaaaaatagacatcttattagttggagatgtcactgtgggctacctggctgatactgtacagaaactatttgcaaacatagcagaagtcaccatcaccatcagtgacacgaaggaggcagcagcgcttttggatgattgcatattcaacatggttctcttgaaggtgccttcttcactaagtgccgaggagctggaagccatcaagttaattagatttggcaaaaagaaaaatacacattcactgtttgtttttataatccctgaaaattttaaaggttgtatttcagggcatggaatggatattgctttaactgaaccactgacaatggaaaaaatgagtaatgtggtaaaatactggacaacatgtccctcaaacactgttaagactgaaaacgcaactgggcctgaagaacttggattgcccctgcagaggtcctacagcgaacacctgggatattttcctactgatctatttgcctgctctgaatctttaaggaatggcaatgggcttgaattaaatgcttcgttgtcagagttcgagaaaaacaaaaagatctctcttcttcattcaagcaaggaaaaactaagaaggctgtacaggaagcatagcagcttctgtttctggtgagccctcaggaagcttacaatcatggcaggaggcaaagtggagccaatgtgtcacatagcaagaggaggagcaagagagagagaaaggagaggccccaaactcttttaaaccaccagatcttgcatgaactgagtgagaactcactcatcaccaaggggatggcgctaagctaagccctagagtgcccccatgatttaacacctcccaccaggttccacctccaacattgggcatcacatttcaccataagatttggaggggacaaaacatccaagccacatcagttatcaacccagcattgttatttgttttgcttaaacagtaagctgtcgcccagttatctaatactgtacaacagattactctgaaacttggtagtggaaatcaacaaactgtttatcatatctcatgattttgtgagtcaccagtttgggcagagcttggctctgtgattcttctcagtgtggtgttaaccatggcactccgtgatgttcagccagcaaaactggcctgtctggagattccagcgcagcgtcatccacacatgtggtcttctggtgggtgtggctgcaggttgtgctcaaatgggctgttcttccctgtggtctcatcacttctccacatggtatctccagcaagctagaaggacctcttacatgaaggcttaggattccatgagaccagtgtgaaagctacatcttctgaaatgctggtcccagaactgtcatagagtcactctccagatatcttttgattaaagcaggcacaggccagtgaagattcaagaggagaggaaatggaccctgactctttgttggagaaataagtaattttcagtgactttaatcttaactcttatctttttaacccaaatttcagattcttgtttgcagtagaacaggctcttcactgtatacaagattttgtctgagttgcaaaaattctctccccatgaatttccctgtattaccatcttttgctcctgcatttccccactcagtcttggctgccacaatcaaagggacataaagtacaaggacacttttttcttgcctctgtagtagaaatcttagcagtatacagctgctctaggcctgtcaaataaatatatactattggtttttaaaacattaataaattagaaaactaccctttaatgtatgccacca

SEQ ID NO: 185600 - DNA, 2193 bp, Homo sapiens
  Payload ID: 16550
  Gene Symbol: SOHLH2
  Gene Name: spermatogenesis and oogenesis specific basic helix-loop-helix 2
  Uniprot ID: Q9NX45
  ENST ID: ENST00000379881
  CDS Start-End: 90-1367
ttagtgcagggggcgggcccgggacgcagcggctgtggagctcctcctgctgggaggctgccccaggacccagcacgtgcgcagcggccatggcttcctcaattatctgccaggagcactgccagatctcgggccaggcaaaaatagacatcttattagttggagatgtcactgtgggctacctggctgatactgtacagaaactatttgcaaacatagcagaagtcaccatcaccatcagtgacacgaaggaggcagcagcgcttttggatgattgcatattcaacatggttctcttgaaggtgccttcttcactaagtgccgaggagctggaagccatcaagttaattagatttggcaaaaagaaaaatacacattcactgtttgtttttataatccctgaaaattttaaaggttgtatttcagggcatggaatggatattgctttaactgaaccactgacaatggaaaaaatgagtaatgtggtaaaatactggacaacatgtccctcaaacactgttaagactgaaaacgcaactgggcctgaagaacttggattgcccctgcagaggtcctacagcgaacacctgggatattttcctactgatctatttgcctgctctgaatctttaaggaatggcaatgggcttgaattaaatgcttcgttgtcagagttcgagaaaaacaaaaagatctctcttcttcattcaagcaaggaaaaactaagaagggaaagaatcaaatattgctgtgagcagctgcgtactctcttgccgtatgtaaaagggagaaagaatgatgcggcttcagttcttgaggcaacagttgattatgtgaaatatatccgggagaaaatctctccagccgttatggcccagattacagaagcacttcagagcaacatgaggttttgtaagaaacaacaaacacccattgagctgtctctcccaggcactgtcatggcacagcgggaaaacagtgtgatgagcacttactcccctgagagagggctccaattcctgactaatacgtgctggaatgggtgctccactcctgatgcagagagctccttggatgaagctgtgagagttccatcaagctccgcctcagagaatgctattggtgatccatataaaactcacatttccagtgcagcgctgtctctgaattccttgcatactgtcagatattattctaaagtcaccccttcctacgatgcaactgctgtaacaaatcagaacatttcaattcatttaccttcagccatgcccccggtctcaaagcttctccctcggcactgcacttctgggttgggccagacgtgcactacacatcccaactgtctgcaacagttttgggcgtattaaaagcacatgtttgaaattcacactctcaaccacctactgggcgcagtttgacaatctaggaaaagtggaacaaagaatgattttgaaagctccacccaaagacctaatatcaaaagagttggcatggtttggcttctgataaatgcactcaaagcttctgcagatagaaagaccagcagcgaaaaagctggccacacactgtcactcatcttcatacacacttggatccccgccagccagagagctacaagaacaaatggcctcagtgacctacactctcttttctcaaaaaatattccacaatttatgaaaaaagcatgctataaggaagatccatgtagacacgataaaatgattagattgggaaggtgtgttgataccttgtgtcactgagtacagatattacaacttgattcttatttttagtatccctgtgaattactgtcactcatttctaggtggtcttttccttatttgacattttagagagtttccttcttcattcaccatccaaactaagatatgcagagagatgctgaaagaggggtttacctcctcacttgacaactaatgaataaattgatgtgtgcttttgcatttcacaatcccttgagtgaaacgatggctaataggtaaatatttctttctggaccttaagttacagactagcaggttttttgtttttcatctcttcctccctatgggtattagaaaggacagttgaaaataagggggaaaaaggtttgttttatatttcactgaattgttcttatatgtaagttttattattaaataaaatactcagttttcaccctgagcattgtaa

SEQ ID NO: 185601 - DNA, 2413 bp, Homo sapiens
  Payload ID: 16551
  Gene Symbol: SPATA12
  Gene Name: spermatogenesis associated 12
  Uniprot ID: Q7Z6I5
  ENST ID: ENST00000334325
  CDS Start-End: 676-1248
ccaggaagtgggtacacctgtccccacccccacagtaggagtcagaatcagggactggaagggatggggttcctggaggaagctcacagcagcagcagcctctgagtcacaactcagcccctccctggcatatccctttgtttgctgggagttgagctgtgactcacaaaggctctggtcccgggctgggcccatgtgacccagggtcctgactgccctgcccacagtcactgagaaaattctttgtgcaggctcaccttcccctcatctcccccactcttcctgatcctgcagcgtcagatcccagcctgcagtatcagacctcaaaaggagcctctggtgtcttccaaaagggaaggaaagagagagaaagccactggagttgggcagcgtgggaagctgtgaaagtggacaagcgtgaaagagcttccaagtagtggaaacagcagaagcaaagatgtgaacatgggaaaacctctgcagtatctgggtgactgtggggtttggctctgtttgagcaccccgggatgattggtggtggggtgtggctgaaggtgaattggaacagtgcactcagagccaggttgcaagagtgctgcatgctcctcagggattggctccggccaagtgccccagcctccttttctggagaattctgtttttgacttgggccccatgtccagttctgctctgacttgtgggtccaccttagaaaagtcaggagacacctgggaaatgaaggcactagactcttccagactcgttccatggccacccagaggccttgggtcatccacccaacatcccaacaaaccccactgtgcactggcatcatgccagggtccaggtgtcctgccaggagcagcctctgccctcccagagctgacatttcagggggatgtgtgccaaagtgagacctgtcagagatatttacaagcagccatctctcttgacatcgctgtatcccaaataaatcttctgggaagaccctcttcacctccagctctcctgatacagcaaggcagttgtgagcaagttattcataactctacacctcaatttcttggtatggaagatggggataatgagaggaccacaggatggttgtggagactgtgtgaggatatagatgccgagcccagtagcacagggtgcagccgttcaaaccaactgacatttactgagggctgctttgtcaggtccctctctacagtatactccaacacacacatacacacacatctgtaatcaataataatcctgcaacatctgagagtctggcagctgtttgtctgggcctttgcacatgctatgccctcccttccatcccccacccccaccaggggtgactcgtagccatccctttctgcatcttcttagatatcactttttccaagaagcctccctgtcacacttccccaatatcacagatgaagaaatcaagattcagaaaggttaagttactggcacaaggtcacacaatccagatctcatactcttagcccccggggaaccttcactgtattaaatgacatcaattgatcaatcaatcgatcaatcaatgaaagagtgggaggcatgcatctcctgatccccgatcctatacattttcatctctttattgtttctatcaaagcctgctaagtaattactttccctctgggtaagtgccactaggtgatgaggtgaggtaatcaaatgacatagaagaggaaggagtccactgccagggtaggtgcagtggagcaagtcttacaatgtgcaggattataactccagcaatgacccctaggctcatgctcattccccaggtggcagtttcagaacacattgctcaggtctcaccctgtaaatgtaggtaccagccttctagttgaccatcagaacacacaacgccaagatcttactccagccacctgccaggacctggagggcaggaggagagttctgcctacattgtctcattttccctccccttctgcagtgagatagaccatgtccagtgctcaggagttgactggccacactggggagtttgaccacaacattgggctccatatgcatggaatgaggttgcatgcaattgtccatgaggctgctccctcatttgtctgggtttctgctccaatgctatctcctcagaaagaccttctctgactgaagccagctctgcctccatcccatcactctggatctccttccccagcttcatctccattacactggccactctccctcacatcttattactgatctagttgtctactgtccatctccaccactgggatgtaaactccacaagggaggaatgctgtcagtttctttgactgctgtgtggtcagtaccagggcaatgcctcgcacagagtagccctctctccctaaatgtttttgaataaatgaaataaatgagc

SEQ ID NO: 185602 - DNA, 6405 bp, Homo sapiens
  Payload ID: 16552
  Gene Symbol: SPATA13
  Gene Name: spermatogenesis associated 13
  Uniprot ID: Q96N96
  ENST ID: ENST00000343003
  CDS Start-End: 314-2104
agtttctgggcaggctctggccgggaacgcatacaacgtcaaagcagtgaataagcgatttctgcagttcccgtagctgccagcctgtgcagtcctctgtgatgcttggggaccggctcctcggtcacaccccagtcctgctctgaaggttgccgttttccaaacagaaggatggtagctagaggggagatagcaagattctggagtctggaaagccttcacttggggtgctttcatgtatcatcattccacttgaggctcaaagcacaccaataacaagtacttgttcagaatgtataaacaaccctgagagatgggttttatcatccacattcaacaggtgaaaaaacaaagaaagaaacttgaccaaggactcatactcaaaaaagaaaaatatagaaaagaaaaaaaatgtgcatcgctatcatttgaagtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagattgcgagtgaatcaggaagagctgtcggaaaactccagcagcacccccagtgaggagcaggacgaggaggccagccagagccgccacagacactgtgagaacaagcagcagatgcggaccaacgtcatccgggagatcatggacaccgagcgggtgtacatcaaacacctcagggacatctgtgagggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaatccactgcttttcaggcaaggagggagaaatcctgctgcacactggctttgtcccggagtcggattccctcctgcctgcacgccttcagtaactccgagcagaaatcacatcttgcccacatgctgtaacctaagaaactgctatgcaaggctgggtgctgtggctcatgcctgtaatcccagcactttgggaggccaaggcaggtggatcacctgaggtcaggagttcgagacaagcgtggccaatatggcaaagcccagtctctactaataatacaaaaattagctgggcatggtggcgcatgcctgtaatcccagctactgggaaggctgaggtaggagaatcttttgaatctgggaagcggaggttgcagtgagctgagatcgcaccactgcactccagcctgggagatacagcgagactgtctccaaaaacaaaaacaaaaacaaaaaacattcaaacaactgtttgcaatataaaaagctcatttactgtaatatttatgatacagtgaatatgaaaatgcactggtcagaaggcactctcaaagagccgcactgctcctgacatcgtccttagcaatgaagtcacaaagacagccaaagcagtcctgcttcttggaaatcagaagctgcctttatcacatataaagccaaacagggcataaccatgtcacgtgagcatgtcatcaggcttctgaggacttgttctttataaaaaaagaccttcacaaaatatcttggcttagagatagcagtctttattaacaaaggccacctaggctgacacctgcagataatcatctccttttctttgtctatgttgtacattttcatgatataacttttaactatgtctagagaaggcaggctctgcaagagaggtgccctttcaacccgctcagtgccctggacaggagatgctgtgttaaactgttaatggatatctatatgagaagctcatttttgtatgctatccctgcagtttttttttttctaacaggcccatgtttgagaataaacaagtctgtgatgtcagagacaaaggtgtattcttcagtctgcaggtgtgtggcacctcccttctcccctgcagccccccacatccagagccgttcctgagagtgacatcatgcatcaagaaaacataaccttggtcctcaggtgaacccttggaacattctgtgaccgcctgatgtccattctgagccaccttggcacacatgcttacaggcagcactgctaagggttcaggtgccccatggctgacagcccgagttgcttctgtggaccatcatgccgctcggcacgtcctgagacagaagttgctgcaggaaggagcttctggagaggtcctgtggcatgtgtgggggtgtgtgtgtgtatgtttccttcttgaacagacattccaactttagatgtgtttatagaactgacctttttactaacaaaatacaatgatatatgttggaaactacttaatatgcttttcctgcacaccttagcaataactgtaggggtctctgctagagttgtttgtatgtacagcaattttgaacaaattgttttaaatgtaatataagagaattagtttaaggaagtaaagagaatcatttgcttgtgttacattttcagtgaggattcagtttaagagtcattcttaggacttccatttcctaatatttattcatgggtaatgaagaaatggtttgcattttgtggccagtcctaatttattttccagctgagccctaacttccggctcccacctacctccacggacttcctaacagagacttatgaataccaggatgtgtttttgttaagtcaggttcaattcgttgcccctgtcagttttatagagtgtgagggtcactccattaaagatctctcctgggtggatcctacttggatgttcaggtgattttgaaaactgctaacatttttaaaaggctagaacatcctttgacttcttgaaaatctgcatgtctggcttgggttttattaccacatgcctgagttcttcaagaatggaaggctcaagtattctcatcttccatttgccaaacttccttcctgatttgagtcacgtgttccacttggaaagaaagggaacagagagcctcctccatggacagtgtatgaatttcattgggaatcttgctctctcccgcctctatgcctttctctctttttaaccttactttacataatattatagatgggccaagaaaagaaaagatgacataacattttgatgaatttcacctattccattcttcacgtttcagaattggtcgactttgttagaagataattgaagtagccttgggtcaaaagcaaccttttcaattgtgatcatacctaaaacatataaaaaccctgccgtagattaaaagcaattataaaatcataaaattgaatgtttgcagaatcctggagcagtagatttctttgtctttggcctgcggactagaaagagggcagcagtagtatgctggagcttccctgggataccagccacatggtttcttttcattagatctgatttttgtttcccactgtagatctgattttgtagttgaaaacatttcaccaccatcaaacactatttctgaatattgtgcctttttatacctagcctagatgaaaaccgatgccattcttattcagaaaatccccccatcctacatgactgttatctagacataaagcaaagtgcatttaattcaaaatttggttcacaatataagtattttgtaaaagccagctgaaccagcattttatcaggtggaaatctctgcaagccaaattgctgatactccttcatgcagatcaacttggtgtcccagtcagaatagaacagcataattacctggagttagggggagtatttctgcactattacttgtcagggagagaagaaacttagaattgtccctcaaaggagtgtcaagaagtatgaataaatgtcctttcaccagctcacaggccagaaatggaggacccaagtcaactaggtgaaactactagcagacccagctttcccataataacctaatctgcaaattgttctattaaagtctcattgttttcaggatgcaatgaaagtggatttcaaaaggctttggaaaaataagtggaacatgactgatcttgaaaaaaaaagcaaaagcttaaatatttgatacaagtttacttagctacaacatactttacattgttgcctttagttatctcacaggcactgacattttatatttagaaaatacttttaatctttctaatctttttttgtaaatattagtgtccattctgtatgactcgctaacctactttgcaaggctttgggcaacattttagctcattaacttcaagatgatgtgtcatctgtataggtcaaagaatgggacttctgaactgaggaatttgctgttgacagccaaagtatagtgtacaagattgatgtaacttgatatgtatttttgttgaagttttttgtaaaaaaaaattatttacaatgttatttgaatgatttttttaaatgctgtgaatctatatttgttgttttgtatattaaaattcatttgccaaactcgt

SEQ ID NO: 185603 - DNA, 6665 bp, Homo sapiens
  Payload ID: 16552
  Gene Symbol: SPATA13
  Gene Name: spermatogenesis associated 13
  Uniprot ID: Q96N96
  ENST ID: ENST00000382095
  CDS Start-End: 408-2366
gtgtgcgttgcgctttctcccgcgatcgccctgccggtcgctagctccgagggcgcgcactggatcccaggctcctccgagagtgcggcgacctcggggctccgccggcaccggaggtggctctgagggcagggacgtgttggacacgctgactttgtaggctccgccaagaggcgccgcaggaggtcgtccctgatggcccctggaggcgaagctcatcacaggatgaggaaaggacagaggcacagagaacccccaagaggagatggggctctgggagacggccaaggcctcggccattctctgactacggccagctggccagccgcagtttgtctattcctgaagactcggttgctgcagacccccagaaggaagaccgtgtggacgaggacccccaggcaagcatgacttctgccagccctgaagaccagaatgctccagtgggctgccccaaaggagcccggagaaggcgccccatttccgtgataggtggggtcagcttgtatgggaccaaccagacggaggaactggacaatcttctgacccaaccggcttccaggccgcccatgcctgctcaccaggtgccaccctacaaggctgtgtcggcccggttccggcccttcacattctcccagagcacccccattgggttggaccgtgtgggacgccggcggcagatgagagcatccaacgtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagattgcgagtgaatcaggaagagctgtcggaaaactccagcagcacccccagtgaggagcaggacgaggaggccagccagagccgccacagacactgtgagaacaagcagcagatgcggaccaacgtcatccgggagatcatggacaccgagcgggtgtacatcaaacacctcagggacatctgtgagggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaatccactgcttttcaggcaaggagggagaaatcctgctgcacactggctttgtcccggagtcggattccctcctgcctgcacgccttcagtaactccgagcagaaatcacatcttgcccacatgctgtaacctaagaaactgctatgcaaggctgggtgctgtggctcatgcctgtaatcccagcactttgggaggccaaggcaggtggatcacctgaggtcaggagttcgagacaagcgtggccaatatggcaaagcccagtctctactaataatacaaaaattagctgggcatggtggcgcatgcctgtaatcccagctactgggaaggctgaggtaggagaatcttttgaatctgggaagcggaggttgcagtgagctgagatcgcaccactgcactccagcctgggagatacagcgagactgtctccaaaaacaaaaacaaaaacaaaaaacattcaaacaactgtttgcaatataaaaagctcatttactgtaatatttatgatacagtgaatatgaaaatgcactggtcagaaggcactctcaaagagccgcactgctcctgacatcgtccttagcaatgaagtcacaaagacagccaaagcagtcctgcttcttggaaatcagaagctgcctttatcacatataaagccaaacagggcataaccatgtcacgtgagcatgtcatcaggcttctgaggacttgttctttataaaaaaagaccttcacaaaatatcttggcttagagatagcagtctttattaacaaaggccacctaggctgacacctgcagataatcatctccttttctttgtctatgttgtacattttcatgatataacttttaactatgtctagagaaggcaggctctgcaagagaggtgccctttcaacccgctcagtgccctggacaggagatgctgtgttaaactgttaatggatatctatatgagaagctcatttttgtatgctatccctgcagtttttttttttctaacaggcccatgtttgagaataaacaagtctgtgatgtcagagacaaaggtgtattcttcagtctgcaggtgtgtggcacctcccttctcccctgcagccccccacatccagagccgttcctgagagtgacatcatgcatcaagaaaacataaccttggtcctcaggtgaacccttggaacattctgtgaccgcctgatgtccattctgagccaccttggcacacatgcttacaggcagcactgctaagggttcaggtgccccatggctgacagcccgagttgcttctgtggaccatcatgccgctcggcacgtcctgagacagaagttgctgcaggaaggagcttctggagaggtcctgtggcatgtgtgggggtgtgtgtgtgtatgtttccttcttgaacagacattccaactttagatgtgtttatagaactgacctttttactaacaaaatacaatgatatatgttggaaactacttaatatgcttttcctgcacaccttagcaataactgtaggggtctctgctagagttgtttgtatgtacagcaattttgaacaaattgttttaaatgtaatataagagaattagtttaaggaagtaaagagaatcatttgcttgtgttacattttcagtgaggattcagtttaagagtcattcttaggacttccatttcctaatatttattcatgggtaatgaagaaatggtttgcattttgtggccagtcctaatttattttccagctgagccctaacttccggctcccacctacctccacggacttcctaacagagacttatgaataccaggatgtgtttttgttaagtcaggttcaattcgttgcccctgtcagttttatagagtgtgagggtcactccattaaagatctctcctgggtggatcctacttggatgttcaggtgattttgaaaactgctaacatttttaaaaggctagaacatcctttgacttcttgaaaatctgcatgtctggcttgggttttattaccacatgcctgagttcttcaagaatggaaggctcaagtattctcatcttccatttgccaaacttccttcctgatttgagtcacgtgttccacttggaaagaaagggaacagagagcctcctccatggacagtgtatgaatttcattgggaatcttgctctctcccgcctctatgcctttctctctttttaaccttactttacataatattatagatgggccaagaaaagaaaagatgacataacattttgatgaatttcacctattccattcttcacgtttcagaattggtcgactttgttagaagataattgaagtagccttgggtcaaaagcaaccttttcaattgtgatcatacctaaaacatataaaaaccctgccgtagattaaaagcaattataaaatcataaaattgaatgtttgcagaatcctggagcagtagatttctttgtctttggcctgcggactagaaagagggcagcagtagtatgctggagcttccctgggataccagccacatggtttcttttcattagatctgatttttgtttcccactgtagatctgattttgtagttgaaaacatttcaccaccatcaaacactatttctgaatattgtgcctttttatacctagcctagatgaaaaccgatgccattcttattcagaaaatccccccatcctacatgactgttatctagacataaagcaaagtgcatttaattcaaaatttggttcacaatataagtattttgtaaaagccagctgaaccagcattttatcaggtggaaatctctgcaagccaaattgctgatactccttcatgcagatcaacttggtgtcccagtcagaatagaacagcataattacctggagttagggggagtatttctgcactattacttgtcagggagagaagaaacttagaattgtccctcaaaggagtgtcaagaagtatgaataaatgtcctttcaccagctcacaggccagaaatggaggacccaagtcaactaggtgaaactactagcagacccagctttcccataataacctaatctgcaaattgttctattaaagtctcattgttttcaggatgcaatgaaagtggatttcaaaaggctttggaaaaataagtggaacatgactgatcttgaaaaaaaaagcaaaagcttaaatatttgatacaagtttacttagctacaacatactttacattgttgcctttagttatctcacaggcactgacattttatatttagaaaatacttttaatctttctaatctttttttgtaaatattagtgtccattctgtatgactcgctaacctactttgcaaggctttgggcaacattttagctcattaacttcaagatgatgtgtcatctgtataggtcaaagaatgggacttctgaactgaggaatttgctgttgacagccaaagtatagtgtacaagattgatgtaacttgatatgtatttttgttgaagttttttgtaaaaaaaaattatttacaatgttatttgaatgatttttttaaatgctgtgaatctatatttgttgttttgtatattaaaattcatttgccaaactc

SEQ ID NO: 185604 - DNA, 8463 bp, Homo sapiens
  Payload ID: 16552
  Gene Symbol: SPATA13
  Gene Name: spermatogenesis associated 13
  Uniprot ID: Q96N96
  ENST ID: ENST00000382108
  CDS Start-End: 329-4162
ggctgagtgtgctgccgcggcgcgggaggagagtgtgcgttgcgctttctcccgcgatcgccctgccggtcgctagctccgagggcgcgcactggatcccaggctcctccgagagtgcggcgacctcggggctccgccggcaccggaggtggctctgagggcagggacgtgttggacacgctgactttgtaggctccgccaagaggcgccgcaggagcccgtggccacccaggagcccgatgtgcaaggcaggtgtgagtgccaggacggcattcctggagatgaaggcctggagctgcggtctgcggactcggcagtgcccgtggccatgacccaggctgccgtgcggccctgggcaccctgcctggagaacatgaccactgccccaaacggcctcgggccaggccccgcagccccctgtgcaggctcggacctgaaagacgccaagatggtgacctcccttgcgtgtggaaatggagtctgtggctgcagccctggtggcgacacggacacccaggaagccaaactcagcccagccaagcttgtgcgcctcttttccaccagtcggaagaggacgggtgcccaccccgagcggccccactccatggtcctggtggggaactcctccacatggaacaccctcgcctccttccggaaaatgggatcctttaagaaactgaagtcctcagtcctgaaaggaattcagagccgagaggggtcaaatgcctgttcaaagggagaggcttcggagcatggcctgggaaagtccatcccaaatggcgctgtcccaggagcccaggcaagcaggggctcccccttagcaccgggaccagcatgtggtgccctcaggccagcagagtggggcacattggatggctccgacctcgaggacacggacgatgccttccagcggagcacacaccgctcccgcagcctccgcagagcctacggcctgggccgcatctgcctgctggatgcgccccagaaccatgcgacacccacgatagccactggccaggtgcccgccgtgtgtgagattctcgtgagggaccctgaaaacaacagcatgggctacaggaggagcaagagcacggacaatcttgcctttctgaagaagagctcctttaagcggaagtccacctccaatcttgcagacctcaggacggcccatgacgcacgggtaccacagaggaccctgagcagttcctccactgactcccaaaagcttgggtcaggaaggaccaaacgctggaggagcccgataagggccaaggactttgacagagtcttcaaacttgtgagcaatgtgactgaggctgcctggaggagggagagtcctaggagtggggccccatcccctggagaggccagcctgagacttcaggcacacagccggctgcatgacgactactcccgccgcgtctccaggagcactgagcaggacagcaggcggggcggggcggtcatgcatgggaccactgcaacctgcaccgtggcccccggtttcggctcagccacctctaaggggccccacctagacgctgacactgccgtatttcctcttgaaaccaaaagttcctgggcggtggaaagcgacagttcctgcacttgcagctctttgccaagcccgattgtccaggatgtgttgagcaaagactcctgtgacccaaacgctggcagccagttgacatttgaccctgagcagcctcccacccctctaaggcccaccacacccaagccccagagccctcagagcccccagagccccggggcaggaagtgccagctgtcacagcaatcacagtgccctgtccgcgaattcagaggaaagtgaaggaagggcagaagagcctgctcagagagagccagggcctgtgtccttgcaggatcccctggaagccacacatggtgatgagggcagcaaggaccttctggtgaacattggtgtggcagccggcccagaagaaaaggagaaggaggaggtcgtccctgatggcccctggaggcgaagctcatcacaggatgaggaaaggacagaggcacagagaacccccaagaggagatggggctctgggagacggccaaggcctcggccattctctgactacggccagctggccagccgcagtttgtctattcctgaagactcggttgctgcagacccccagaaggaagaccgtgtggacgaggacccccaggcaagcatgacttctgccagccctgaagaccagaatgctccagtgggctgccccaaaggagcccggagaaggcgccccatttccgtgataggtggggtcagcttgtatgggaccaaccagacggaggaactggacaatcttctgacccaaccggcttccaggccgcccatgcctgctcaccaggtgccaccctacaaggctgtgtcggcccggttccggcccttcacattctcccagagcacccccattgggttggaccgtgtgggacgccggcggcagatgagagcatccaacgtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagattgcgagtgaatcaggaagagctgtcggaaaactccagcagcacccccagtgaggagcaggacgaggaggccagccagagccgccacagacactgtgagaacaagcagcagatgcggaccaacgtcatccgggagatcatggacaccgagcgggtgtacatcaaacacctcagggacatctgtgagggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaatccactgcttttcaggcaaggagggagaaatcctgctgcacactggctttgtcccggagtcggattccctcctgcctgcacgccttcagtaactccgagcagaaatcacatcttgcccacatgctgtaacctaagaaactgctatgcaaggctgggtgctgtggctcatgcctgtaatcccagcactttgggaggccaaggcaggtggatcacctgaggtcaggagttcgagacaagcgtggccaatatggcaaagcccagtctctactaataatacaaaaattagctgggcatggtggcgcatgcctgtaatcccagctactgggaaggctgaggtaggagaatcttttgaatctgggaagcggaggttgcagtgagctgagatcgcaccactgcactccagcctgggagatacagcgagactgtctccaaaaacaaaaacaaaaacaaaaaacattcaaacaactgtttgcaatataaaaagctcatttactgtaatatttatgatacagtgaatatgaaaatgcactggtcagaaggcactctcaaagagccgcactgctcctgacatcgtccttagcaatgaagtcacaaagacagccaaagcagtcctgcttcttggaaatcagaagctgcctttatcacatataaagccaaacagggcataaccatgtcacgtgagcatgtcatcaggcttctgaggacttgttctttataaaaaaagaccttcacaaaatatcttggcttagagatagcagtctttattaacaaaggccacctaggctgacacctgcagataatcatctccttttctttgtctatgttgtacattttcatgatataacttttaactatgtctagagaaggcaggctctgcaagagaggtgccctttcaacccgctcagtgccctggacaggagatgctgtgttaaactgttaatggatatctatatgagaagctcatttttgtatgctatccctgcagtttttttttttctaacaggcccatgtttgagaataaacaagtctgtgatgtcagagacaaaggtgtattcttcagtctgcaggtgtgtggcacctcccttctcccctgcagccccccacatccagagccgttcctgagagtgacatcatgcatcaagaaaacataaccttggtcctcaggtgaacccttggaacattctgtgaccgcctgatgtccattctgagccaccttggcacacatgcttacaggcagcactgctaagggttcaggtgccccatggctgacagcccgagttgcttctgtggaccatcatgccgctcggcacgtcctgagacagaagttgctgcaggaaggagcttctggagaggtcctgtggcatgtgtgggggtgtgtgtgtgtatgtttccttcttgaacagacattccaactttagatgtgtttatagaactgacctttttactaacaaaatacaatgatatatgttggaaactacttaatatgcttttcctgcacaccttagcaataactgtaggggtctctgctagagttgtttgtatgtacagcaattttgaacaaattgttttaaatgtaatataagagaattagtttaaggaagtaaagagaatcatttgcttgtgttacattttcagtgaggattcagtttaagagtcattcttaggacttccatttcctaatatttattcatgggtaatgaagaaatggtttgcattttgtggccagtcctaatttattttccagctgagccctaacttccggctcccacctacctccacggacttcctaacagagacttatgaataccaggatgtgtttttgttaagtcaggttcaattcgttgcccctgtcagttttatagagtgtgagggtcactccattaaagatctctcctgggtggatcctacttggatgttcaggtgattttgaaaactgctaacatttttaaaaggctagaacatcctttgacttcttgaaaatctgcatgtctggcttgggttttattaccacatgcctgagttcttcaagaatggaaggctcaagtattctcatcttccatttgccaaacttccttcctgatttgagtcacgtgttccacttggaaagaaagggaacagagagcctcctccatggacagtgtatgaatttcattgggaatcttgctctctcccgcctctatgcctttctctctttttaaccttactttacataatattatagatgggccaagaaaagaaaagatgacataacattttgatgaatttcacctattccattcttcacgtttcagaattggtcgactttgttagaagataattgaagtagccttgggtcaaaagcaaccttttcaattgtgatcatacctaaaacatataaaaaccctgccgtagattaaaagcaattataaaatcataaaattgaatgtttgcagaatcctggagcagtagatttctttgtctttggcctgcggactagaaagagggcagcagtagtatgctggagcttccctgggataccagccacatggtttcttttcattagatctgatttttgtttcccactgtagatctgattttgtagttgaaaacatttcaccaccatcaaacactatttctgaatattgtgcctttttatacctagcctagatgaaaaccgatgccattcttattcagaaaatccccccatcctacatgactgttatctagacataaagcaaagtgcatttaattcaaaatttggttcacaatataagtattttgtaaaagccagctgaaccagcattttatcaggtggaaatctctgcaagccaaattgctgatactccttcatgcagatcaacttggtgtcccagtcagaatagaacagcataattacctggagttagggggagtatttctgcactattacttgtcagggagagaagaaacttagaattgtccctcaaaggagtgtcaagaagtatgaataaatgtcctttcaccagctcacaggccagaaatggaggacccaagtcaactaggtgaaactactagcagacccagctttcccataataacctaatctgcaaattgttctattaaagtctcattgttttcaggatgcaatgaaagtggatttcaaaaggctttggaaaaataagtggaacatgactgatcttgaaaaaaaaagcaaaagcttaaatatttgatacaagtttacttagctacaacatactttacattgttgcctttagttatctcacaggcactgacattttatatttagaaaatacttttaatctttctaatctttttttgtaaatattagtgtccattctgtatgactcgctaacctactttgcaaggctttgggcaacattttagctcattaacttcaagatgatgtgtcatctgtataggtcaaagaatgggacttctgaactgaggaatttgctgttgacagccaaagtatagtgtacaagattgatgtaacttgatatgtatttttgttgaagttttttgtaaaaaaaaattatttacaatgttatttgaatgatttttttaaatgctgtgaatctatatttgttgttttgtatattaaaattcatttgccaaactcgt

SEQ ID NO: 185605 - DNA, 3026 bp, Homo sapiens
  Payload ID: 16552
  Gene Symbol: SPATA13
  Gene Name: spermatogenesis associated 13
  Uniprot ID: Q96N96
  ENST ID: ENST00000399949
  CDS Start-End: 171-1895
gtttctgggcaggctctggccgggaacgcatacaacgtcaaagcagtgaataagcgatttctgcagttcccgtagctgccagcctgtgcagtcctctgtgatgcttggggaccggctcctcggtcacaccccagtcctgctctgaaggttgccgttttccaaacagaaggatggtagctagaggggagatagcaagattctggagtctggaaagccttcacttggtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagattgcgagtgaatcaggaagagctgtcggaaaactccagcagcacccccagtgaggagcaggacgaggaggccagccagagccgccacagacactgtgagaacaagcagcagatgcggaccaacgtcatccgggagatcatggacaccgagcgggtgtacatcaaacacctcagggacatctgtgagggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaatccactgcttttcaggcaaggagggagaaatcctgctgcacactggctttgtcccggagtcggattccctcctgcctgcacgccttcagtaactccgagcagaaatcacatcttgcccacatgctgtaacctaagaaactgctatgcaaggctgggtgctgtggctcatgcctgtaatcccagcactttgggaggccaaggcaggtggatcacctgaggtcaggagttcgagacaagcgtggccaatatggcaaagcccagtctctactaataatacaaaaattagctgggcatggtggcgcatgcctgtaatcccagctactgggaaggctgaggtaggagaatcttttgaatctgggaagcggaggttgcagtgagctgagatcgcaccactgcactccagcctgggagatacagcgagactgtctcc

SEQ ID NO: 185606 - DNA, 2111 bp, Homo sapiens
  Payload ID: 16552
  Gene Symbol: SPATA13
  Gene Name: spermatogenesis associated 13
  ENST ID: ENST00000409126
  CDS Start-End: 140-1678
acaacgtcaaagcagtgaataagcgatttctgcagttcccgtagctgccagcctgtgcagtcctctgtgatgcttggggaccggctcctcggtcacaccccagtcctgctctgaaggttgccgttttccaaacagaaggatggtagctagaggggagatagcaagattctggagtctggaaagccttcacttggtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagaggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtc

SEQ ID NO: 185607 - DNA, 597 bp, Homo sapiens
  Payload ID: 16552
  Gene Symbol: SPATA13
  Gene Name: spermatogenesis associated 13
  ENST ID: ENST00000454083
  CDS Start-End: 160-597
gttttccaaacagaaggatggtagctagaggggagatagcaagattctggagtctggaaagccttcacttggggtgctttcatgtatcatcattccacttgaggctcaaagcacaccaataacaagtacttgttcagaatgtataaacaaccctgagagatgggttttatcatccacattcaacaggtgaaaaaacaaagaaagaaacttgaccaaggactcatactcaaaaaagaaaaatatagaaaagaaaaaaaatgtgcatcgctatcatttgaagtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcaga

SEQ ID NO: 185608 - DNA, 8603 bp, Homo sapiens
  Payload ID: 16552
  Gene Symbol: SPATA13
  Gene Name: spermatogenesis associated 13
  Uniprot ID: Q96N96
  ENST ID: ENST00000424834
  CDS Start-End: 474-4307
gcgcacccgggacagtttccagtcggcttctccgtgaccttcctcccccttccagctcggagcgggatgctgggatccctccaaggaccctctgaggacgtaggagggatgctgagacagggccagcttcaaaccttgtcaagctctgacaagggaagatgaagcctagttccagctaggggtgacctgtctatctgcattttttgagctgcagagtgatgggagtcatattcgctgcctgtgcagcaccacaggcctgatgaaaatgaaatggcaacaccgtgcagatggcaaagcgtaggcctcacaaacatcctggccgtgaagagcttgtcttcaagagtagctggtgcagaaactcgcccgtggccacccaggagcccgatgtgcaaggcaggtgtgagtgccaggacggcattcctggagatgaaggcctggagctgcggtctgcggactcggcagtgcccgtggccatgacccaggctgccgtgcggccctgggcaccctgcctggagaacatgaccactgccccaaacggcctcgggccaggccccgcagccccctgtgcaggctcggacctgaaagacgccaagatggtgacctcccttgcgtgtggaaatggagtctgtggctgcagccctggtggcgacacggacacccaggaagccaaactcagcccagccaagcttgtgcgcctcttttccaccagtcggaagaggacgggtgcccaccccgagcggccccactccatggtcctggtggggaactcctccacatggaacaccctcgcctccttccggaaaatgggatcctttaagaaactgaagtcctcagtcctgaaaggaattcagagccgagaggggtcaaatgcctgttcaaagggagaggcttcggagcatggcctgggaaagtccatcccaaatggcgctgtcccaggagcccaggcaagcaggggctcccccttagcaccgggaccagcatgtggtgccctcaggccagcagagtggggcacattggatggctccgacctcgaggacacggacgatgccttccagcggagcacacaccgctcccgcagcctccgcagagcctacggcctgggccgcatctgcctgctggatgcgccccagaaccatgcgacacccacgatagccactggccaggtgcccgccgtgtgtgagattctcgtgagggaccctgaaaacaacagcatgggctacaggaggagcaagagcacggacaatcttgcctttctgaagaagagctcctttaagcggaagtccacctccaatcttgcagacctcaggacggcccatgacgcacgggtaccacagaggaccctgagcagttcctccactgactcccaaaagcttgggtcaggaaggaccaaacgctggaggagcccgataagggccaaggactttgacagagtcttcaaacttgtgagcaatgtgactgaggctgcctggaggagggagagtcctaggagtggggccccatcccctggagaggccagcctgagacttcaggcacacagccggctgcatgacgactactcccgccgcgtctccaggagcactgagcaggacagcaggcggggcggggcggtcatgcatgggaccactgcaacctgcaccgtggcccccggtttcggctcagccacctctaaggggccccacctagacgctgacactgccgtatttcctcttgaaaccaaaagttcctgggcggtggaaagcgacagttcctgcacttgcagctctttgccaagcccgattgtccaggatgtgttgagcaaagactcctgtgacccaaacgctggcagccagttgacatttgaccctgagcagcctcccacccctctaaggcccaccacacccaagccccagagccctcagagcccccagagccccggggcaggaagtgccagctgtcacagcaatcacagtgccctgtccgcgaattcagaggaaagtgaaggaagggcagaagagcctgctcagagagagccagggcctgtgtccttgcaggatcccctggaagccacacatggtgatgagggcagcaaggaccttctggtgaacattggtgtggcagccggcccagaagaaaaggagaaggaggaggtcgtccctgatggcccctggaggcgaagctcatcacaggatgaggaaaggacagaggcacagagaacccccaagaggagatggggctctgggagacggccaaggcctcggccattctctgactacggccagctggccagccgcagtttgtctattcctgaagactcggttgctgcagacccccagaaggaagaccgtgtggacgaggacccccaggcaagcatgacttctgccagccctgaagaccagaatgctccagtgggctgccccaaaggagcccggagaaggcgccccatttccgtgataggtggggtcagcttgtatgggaccaaccagacggaggaactggacaatcttctgacccaaccggcttccaggccgcccatgcctgctcaccaggtgccaccctacaaggctgtgtcggcccggttccggcccttcacattctcccagagcacccccattgggttggaccgtgtgggacgccggcggcagatgagagcatccaacgtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagattgcgagtgaatcaggaagagctgtcggaaaactccagcagcacccccagtgaggagcaggacgaggaggccagccagagccgccacagacactgtgagaacaagcagcagatgcggaccaacgtcatccgggagatcatggacaccgagcgggtgtacatcaaacacctcagggacatctgtgagggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtccaaacacagcatccagggctttgcagttcctaaggagtgatgaggttagaggatcacttctgcatttgattttcaaggatgccgtcaagacggggttgacacaatgctgcacgtgtctggtcacacttagaaattgagctcttactctcttctgtaatactgggggacctacagctgccgtggggctgaccacggtgttccctggcatcgtctgtgtccacacagatgctaactggtagtgcaaatgtcatcctgcaaggttcctcttcctgcaagcaaagtggagagaaagaagatgcatctgtcaccttcatcagggtcctcagtgcagagcaacttacgcatcctcaagaatccactgcttttcaggcaaggagggagaaatcctgctgcacactggctttgtcccggagtcggattccctcctgcctgcacgccttcagtaactccgagcagaaatcacatcttgcccacatgctgtaacctaagaaactgctatgcaaggctgggtgctgtggctcatgcctgtaatcccagcactttgggaggccaaggcaggtggatcacctgaggtcaggagttcgagacaagcgtggccaatatggcaaagcccagtctctactaataatacaaaaattagctgggcatggtggcgcatgcctgtaatcccagctactgggaaggctgaggtaggagaatcttttgaatctgggaagcggaggttgcagtgagctgagatcgcaccactgcactccagcctgggagatacagcgagactgtctccaaaaacaaaaacaaaaacaaaaaacattcaaacaactgtttgcaatataaaaagctcatttactgtaatatttatgatacagtgaatatgaaaatgcactggtcagaaggcactctcaaagagccgcactgctcctgacatcgtccttagcaatgaagtcacaaagacagccaaagcagtcctgcttcttggaaatcagaagctgcctttatcacatataaagccaaacagggcataaccatgtcacgtgagcatgtcatcaggcttctgaggacttgttctttataaaaaaagaccttcacaaaatatcttggcttagagatagcagtctttattaacaaaggccacctaggctgacacctgcagataatcatctccttttctttgtctatgttgtacattttcatgatataacttttaactatgtctagagaaggcaggctctgcaagagaggtgccctttcaacccgctcagtgccctggacaggagatgctgtgttaaactgttaatggatatctatatgagaagctcatttttgtatgctatccctgcagtttttttttttctaacaggcccatgtttgagaataaacaagtctgtgatgtcagagacaaaggtgtattcttcagtctgcaggtgtgtggcacctcccttctcccctgcagccccccacatccagagccgttcctgagagtgacatcatgcatcaagaaaacataaccttggtcctcaggtgaacccttggaacattctgtgaccgcctgatgtccattctgagccaccttggcacacatgcttacaggcagcactgctaagggttcaggtgccccatggctgacagcccgagttgcttctgtggaccatcatgccgctcggcacgtcctgagacagaagttgctgcaggaaggagcttctggagaggtcctgtggcatgtgtgggggtgtgtgtgtgtatgtttccttcttgaacagacattccaactttagatgtgtttatagaactgacctttttactaacaaaatacaatgatatatgttggaaactacttaatatgcttttcctgcacaccttagcaataactgtaggggtctctgctagagttgtttgtatgtacagcaattttgaacaaattgttttaaatgtaatataagagaattagtttaaggaagtaaagagaatcatttgcttgtgttacattttcagtgaggattcagtttaagagtcattcttaggacttccatttcctaatatttattcatgggtaatgaagaaatggtttgcattttgtggccagtcctaatttattttccagctgagccctaacttccggctcccacctacctccacggacttcctaacagagacttatgaataccaggatgtgtttttgttaagtcaggttcaattcgttgcccctgtcagttttatagagtgtgagggtcactccattaaagatctctcctgggtggatcctacttggatgttcaggtgattttgaaaactgctaacatttttaaaaggctagaacatcctttgacttcttgaaaatctgcatgtctggcttgggttttattaccacatgcctgagttcttcaagaatggaaggctcaagtattctcatcttccatttgccaaacttccttcctgatttgagtcacgtgttccacttggaaagaaagggaacagagagcctcctccatggacagtgtatgaatttcattgggaatcttgctctctcccgcctctatgcctttctctctttttaaccttactttacataatattatagatgggccaagaaaagaaaagatgacataacattttgatgaatttcacctattccattcttcacgtttcagaattggtcgactttgttagaagataattgaagtagccttgggtcaaaagcaaccttttcaattgtgatcatacctaaaacatataaaaaccctgccgtagattaaaagcaattataaaatcataaaattgaatgtttgcagaatcctggagcagtagatttctttgtctttggcctgcggactagaaagagggcagcagtagtatgctggagcttccctgggataccagccacatggtttcttttcattagatctgatttttgtttcccactgtagatctgattttgtagttgaaaacatttcaccaccatcaaacactatttctgaatattgtgcctttttatacctagcctagatgaaaaccgatgccattcttattcagaaaatccccccatcctacatgactgttatctagacataaagcaaagtgcatttaattcaaaatttggttcacaatataagtattttgtaaaagccagctgaaccagcattttatcaggtggaaatctctgcaagccaaattgctgatactccttcatgcagatcaacttggtgtcccagtcagaatagaacagcataattacctggagttagggggagtatttctgcactattacttgtcagggagagaagaaacttagaattgtccctcaaaggagtgtcaagaagtatgaataaatgtcctttcaccagctcacaggccagaaatggaggacccaagtcaactaggtgaaactactagcagacccagctttcccataataacctaatctgcaaattgttctattaaagtctcattgttttcaggatgcaatgaaagtggatttcaaaaggctttggaaaaataagtggaacatgactgatcttgaaaaaaaaagcaaaagcttaaatatttgatacaagtttacttagctacaacatactttacattgttgcctttagttatctcacaggcactgacattttatatttagaaaatacttttaatctttctaatctttttttgtaaatattagtgtccattctgtatgactcgctaacctactttgcaaggctttgggcaacattttagctcattaacttcaagatgatgtgtcatctgtataggtcaaagaatgggacttctgaactgaggaatttgctgttgacagccaaagtatagtgtacaagattgatgtaacttgatatgtatttttgttgaagttttttgtaaaaaaaaattatttacaatgttatttgaatgatttttttaaatgctgtgaatctatatttgttgttttgtatattaaaattcatttgccaaa

SEQ ID NO: 185609 - DNA, 2001 bp, Homo sapiens
  Payload ID: 16552
  Gene Symbol: SPATA13
  Gene Name: spermatogenesis associated 13
  ENST ID: ENST00000434675
  CDS Start-End: 1-1653
acagattttgctttctttttgcagccggcttccaggccgcccatgcctgctcaccaggtgccaccctacaaggctgtgtcggcccggttccggcccttcacattctcccagagcacccccattgggttggaccgtgtgggacgccggcggcagatgagagcatccaacgtttcttcagatggaggtactgagccctctgccttagtggatgacaacggtagtgaggaggacttcagctatgaagacctctgccaggccagccctcggtacctgcagcccggcggggagcagctggccatcaatgagctgatcagtgatggcaacgtggtctgcgcagaagccctgtgggaccatgtgaccatggatgaccaggaactgggcttcaaagccggggatgtcatccaggttctggaagcctccaacaaggactggtggtggggccgcagtgaagataaggaagcctggttccccgcgagcttcgtcagaggctatatccgacagtgccgcaagcacacaggaatgttcaccgttgcgcagctagccactatttttggaaacattgaagatatttacaaattccaaagaaagtttctgaaagaccttgagaaacagtacaacaaagaggaacctcacttaagtgaaataggatcttgctttcttcaaaatcaagagggctttgccatctattccgagtactgcaacaaccacccgggcgcctgcctggagctcgccaacctcatgaagcagggcaagtacagacatttctttgaagcctgccgcctgctgcagcagatgattgacatcgccatcgacgggttcctgctcacaccagtgcagaagatctgcaaatacccgctgcagctggccgagctgctcaagtataccacacaggaacacggtgattacagcaacataaaggcagcatatgaggccatgaagaatgtggcctgtctgatcaacgagcgcaagcgcaagctggagagcatcgacaagatagctcgctggcaggtgtctatcgtgggctgggagggactggatatcttagaccgaagctcagaattgattcattctggggagctgaccaaaatcactaagcaaggcaaaagccagcagcggacgttcttcctgtttgaccaccagctggtgtcctgcaagaaggacctgctgcgcagggacatgctgtactacaagggccggctggacatggatgagatggagcttgtggacctgggggatgggcgcgacaaggactgcaacctcagcgtgaaaaatgccttcaagctcgtcagtaggaccacagacgaggtttatttgttttgtgccaaaaaacaagaagacaaggcgaggtggctgcaggcctgtgcagatgaaaggaggcgggtgcaagaggacaaggagatgggaatggaaatttcagaaaaccagaagaaacttgccatgttaaatgctcaaaaggcaggacatggaaagtcaaaaggctacaacaggtgccctgtggccccaccgcaccagggcctgcaccccatccaccagcgccacatcactatgcccacaagcgtcccccagcagcaggtctttggcctggcggaacccaagaggaagtcctcgctcttctggcacaccttcaacaggctcacccccttccggaaatgaaaacaggaggctgtgcttccatggagctgggtgtcaagagaagaactgtctttgtttcttgtgtgcttcaatccagggaaagtttcttggacccagtgataaaaacttccttttagggatcaatgaaggagagaaggtcttggaatcaccttcagtctttggagacccagctgcctttgtggaagggaggagacggtcatgacacaaagctttatcctacacagaaacacccgtgacccactatgagatggcccagatgtgggacccggtaccatgctctaaagcgagtgattaggcagcagctgaagccacccctgctgatgatgagcaagtgcctgctgcaggtcc

SEQ ID NO: 185610 - DNA, 301 bp, Homo sapiens
  Payload ID: 16552
  Gene Symbol: SPATA13
  Gene Name: spermatogenesis associated 13
  ENST ID: ENST00000494772
  CDS Start-End: 233-301
ccggcttccaggccgcccatgcctgctcaccaggtgccaccctacaaggctgtgtcggcccggttccggcccttcacattctcccagagcacccccattgggttggaccgtgtgggacgccggcggcagatgagagcatccaacgggtgctttcatgtatcatcattccacttgaggctcaaagcacaccaataacaagtacttgttcagaatgtataaacaaccctgagagatgggttttatcatccacattcaacaggtgaaaaaacaaagaaagaaacttgaccaaggactcatactc

SEQ ID NO: 185611 - DNA, 605 bp, Homo sapiens
  Payload ID: 16552
  Gene Symbol: SPATA13
  Gene Name: spermatogenesis associated 13
  ENST ID: ENST00000488060
  CDS Start-End: 537-605
gagacaggctcatagcaggatcgctttgctggcagacacacctggctttgaatccagccccgcaacttggggaaagttacttaacatctttgagccacggtttcctccttcataaccagacagcaacactccaagatgcttgtgaggctctcaagaggatttattccagcgctgagcgcagtgcctggcgcacattaagatgccaggaagccggatgggtgattgctcaggtctgtccagccagttgggcagccgtcagaaactgggagggctgacgagacaccagcccagagagctgtcagggagcggcagagcagaggagagggcccaggatggatcggcaggtgtcagccaggatggacgggaggagccgtgctcagagccagcagccccaggacgagcagctcctggctaggaacagaagacaggcactgtgggacaagtcaaagggtgctttcatgtatcatcattccacttgaggctcaaagcacaccaataacaagtacttgttcagaatgtataaacaaccctgagagatgggttttatcatccacattcaacaggtgaaaaaacaaagaaagaaacttgaccaaggactcatactc

SEQ ID NO: 185612 - DNA, 2106 bp, Homo sapiens
  Payload ID: 16553
  Gene Symbol: SPATA16
  Gene Name: spermatogenesis associated 16
  Uniprot ID: Q9BXB7
  ENST ID: ENST00000351008
  CDS Start-End: 185-1894
atgggcctcgtggcacgggacgtttcaagtcctggcgtccccgcgagcaagcagcctgatcaggcctcgcagtgggacgttgggaagccggtgttggcagatgctgtggctgggaggagtccagagcttcgccctgtccccgcggggctgagccacaactgcttaggagttttgggcaggatcgatggatgcaggaagcagtaggagtttggagaatgcagtgaataggatctatcatgatcagcttgttccaaagataaacacaagcaagaaaatgtccaccttagcgcacccacctaacatcctggaaatgtcacaagagattaagaaaaactgtggaggtaaacaggtagaaatcacacttgaaagaacaaaaatgacaaagggcatcaaagaaaaacaaagcaatgatttagagaaagcagcctttaaacggaaggcagaaggtgaagaaaagccaactagaaagaaacaggcaaagataacagaacttgacaatcagttaatcaccatgcctctgcctcacatccccttaaagaacataatggatgtggaaatgaagttggtctacattgatgaaatgggtgttcgctatgagtttgtagagtccttcatgtctactgggagtcagccaacatgccaagctgctgaaatagtagaccctttgagtgtacataatttcagctttctgcctcagattgacaaatggcttcaggtagccttaaaggatgccagctcttgctatagacaaaagaaatacgccttggcagcaggacagttcagaacagcacttgagctttgcagcaaaggagcagttctgggagaaccatttgatgcacctgctgaagatatagcaagcgtggcaagtttcattgagacaaagcttgttacctgttatctacggatgaggaaaccagatcttgccctgaatcatgcacacaggagcattgttttaaacccagcctatttccggaatcatcttcgtcaagcaacagtgtttagatgtctggagaggtattcagaggctgcccggagtgccatgattgctgactacatgttctggcttggtggaggaagggaagagagcataagcaagctcatcaaactgtattggcaggccatgattgaggaagccatcaccagagctgaatctttctcggttatgtacacaccatttgcgacaaaaataagagctgataaaatagaaaaagtaaaagatgctttcacaaaaactcatcctgcatatgcagagtatatgtacacagatcttcaagcactccacatgttgcctcagacagttgactggtcatcttttcctccccaacaatatctcttgactcttgggttcaaaaacaaagatgatggaaaatttttggaaaaaatatcaagcaggaagctgccgatattcacagagcataaaacacctttcggtctgaccagagaagatacagtgaggcaaatggagacaatggggaagcgaatcttgccaatattggattttattagaagcacccaattgaatgggagttttcctgcatcctcaggtgtgatggagaagttgcaatatgccagcctcctcagccagctgcagagagtaaaggagcagtcccaggtgattaatcaagcaatggcagagctagcaaccattccctacctacaggacatcagtcaacaggaggcagaattgctgcagtcactaatggcagatgctatggacacccttgaaggaagaagaaacaataatgaacgtgtgtggaatatgatccaaaaggttggacaaattgaagattttctataccaattagaggacagtttcttaaaaactaaaaaactgagaactgctcgaaggcaaaaaacaaaaatgaagcgacttcaaactgttcagcaaaggtagtcattagggagcaggcactaccactaagatatcccagaagaagaggcaagggcatccactccaatgcccacctagtactgtgaagctggataacaaaagcttgtcaccaaaagaaagaggtggtattcccctcagttcatctttaccaaagacactctatgtttcattaatctcaactggcagcaataaatattctcagcaagtttgacttg

SEQ ID NO: 185613 - DNA, 5818 bp, Homo sapiens
  Payload ID: 16554
  Gene Symbol: SPATA17
  Gene Name: spermatogenesis associated 17
  Uniprot ID: Q96L03
  ENST ID: ENST00000366933
  CDS Start-End: 56-1141
cagttaccatggagaccggtagtaacaccagttgtaaacccaaggccaagagaccatggccacgttagcccggctgcaagctaggtcgtcgactgtaggaaatcagtactactttaggaacagtgttgtagatccatttagaaaaaaggagaatgatgcagcagttaaaatccaaagctggtttcgaggatgtcaagttcgggcatatatcaggcatttaaacaggattgtaacaattattcaaaaatggtggagaagtttcttaggcagaaagcaatatcaactaactgtgcaggtagcatattatactatgatgatgaatctctacaatgcaatggctgtcaggattcagagacgatggcgaggctatagggttcggaagtacctctttaattattattatttgaaagagtacctgaaagtcgtttcagagaccaatgatgcaattaggaaggcactggaggagtttgcagaaatgaaagaaagagaagagaagaaggctaacctcgaaagggaagagaagaaaagagattaccaagcccgaaagatgcattacctcctcagcacaaagcagattccaggaatatacaattcacccttcagaaaagagcctgatccatgggagctgcaattacagaaggcaaagcctttaacacaccgaagacctaaagttaagcagaaggactccaccagccttactgattggctagcttgtacaagcgcccgttcttttcctcggtctgaaattctaccacctattaatagaaagcaatgtcaggggcccttccgagatatcaccgaagtattagaacaacgctacaggcctttggagccaacgttgcgggtggcagaaccaatcgatgagttaaagttggccagagaggagctcagaagagaggaatggctgcaaaatgtaaatgacaatatgtttttgccattttcttcataccataaaaatgaaaagtacatcccatcaatgcatttatcaagcaagtatggtcctatttcttacaaagaacaattccgaagtgaaaatcctaagaaatggatctgtgacaaggatttccagactgtattaccatcatttgagctcttctcaaagtatggaaaattatattcaaaagctggacagattgtataaaggcgtcagaagaagaaactgaagccatctgcattttaaaacttaacagttctgaaaggaaaacacagatgaagatcctgtaggaaatatacttgctatgattcaataaactataaaattttgtagctctagtcatgaattaattattgtgtgtatgtatttgaaatctcttagacatatcttttcaaacaaatacttaaacttgagtctgttacctctgagaatgtctgtcacaatcacagcccctggtgaccaacagtgccataaatggttcccctgaaatacccatattctgaccccatcacccgggtcacaaatgatgacaccagtgctgggtacccaaattaagggcgactaacatgtaagtaggatgatgaatggtttgaagtgtaaattgtgtgaaatagttcagcatgaaagctctgccctgagaaataatgactgattataccagttagaaacccttcagactgttgaacttgagacacacagacacaacagacacagactagtgggtgtgggagcagaagcataggcactctcaaatagagaagacatttgcaagtctctgctgccaagggagcaaagagataatctcgatgccagggctgtgtcagatcctgcatggctctgaactacagttggtttccaaaaagctgggcttttgtgaggtttctgttttttatgcgatgcttagattttcctggaatccttggaagttaactcaacatttgaggttcctatatcctttaatcccatcccatgtgtatctttacaataaaacttcctgctagaggtatcctgagggaatctttgtttcttgcatctgaagagaataacactaaacttattgcatatgatttgggggttggatccaatgatagcacagagggacaggaaatgtgatttattgaccataaaagctttaatttaaaattgctggccagcgaaatccagactctgggaaatgttataggccaaatgatctgtttcttcaacaaataaattacaaaactgaggggaaaaaaaggaacctattaaaaagacattatctatcaatcactgtgtgtgtacagttttgagctcctgatttaaataaacaaattgtaaaataaaagatcttttgaaacaattggaagtttgaacactgattggatattggtggtataaaagaattattggttttttttaggtgtcatggtattgttttggtttacaaagttatagatataaatgttgaaatatttacagatgcagtgatatgttggctgggatttaatttgaaagtcaaagaagtgagttaaaatacatatactcctcctcttataatcggttatgtgccaataaatccattgtaaattgaaaatatcctaagttgaaaatattgtaagttaaaaatgcatttaatacagctaacttaccagacagcttagcttagcctcacctaccttaaatatgctcagaacacatacgttagcctatagttgggcaaaatcatctaacacaaagcctattttataatattgaacagcccatgtaatttattgaatattgtactaaaagtgaaaaactgaatagttgtatgcatactcaaagtatggtttctactgaatgcattgtaaaccagaaagtatctgagacaatgttttttttttttttttttttttttttaatttctgagacagagtctcattctgtcacccaggttggagtgcagtggcatgaactcagctcactgcaaccttcacctcccaggctcaagcagtcctcccatctcagcctcccaagtagctgggaccacaggcatgggccaacaagcctggctaaatattttgtacttttggtagacacgggtttttaccatgttgtgcaggctggtcttgaacgcctgagctcaagtgatctgcctgcctcggcctcccaaagtactgggattacaggcatgagtcactgaacccagccctgagacatgtctcaattagtttagaagtttatttggccaaggttaaggacatgcccttgacactgcacctgtcagtacaggtcctgacaacatgtgtccaaggtggtcaagctatacaacttggttttatacattttaaggagacataagacatcaataaatacatggaagatgtacattggttcagtctggaaaggcaggatgcctcaaacttgaaacaagagaatggggggtgggaggatgtgggagatgcttccaggtcatagttggagtcaaagactttccaattggcaattggttcaaagaatttatctaaagacctggaatccatagaaggctttacctggattaaaataaggggaccaaggttctcatgcagatgaagcctccaggtggcagacttcagagagcatagattgtaaatgtttcttatctgacttaaaaaggtgtcagactcttagtaaattatctcctggatcagtgaaaagatgtgaaaaaaggttctctacagaatgtagattttccccataagagatagcttcgcagggccattgcaaaatatgtcaaaaatatatattttagggtaaaatgcctcaatttatttcaaggcctgatatttgtcatgtgatgctatactacagtcaggctgaaacttggcatcttattgctatgaaaaatcttaagatctctattttaatgttaatgctggtcactggtgcctgaattccaaagggaggagggtataatgaagcatgtccaattccccatgccccacccccacccccacatcctataatggcctgaactagtttttcaggttaactttggaatacccttggccaagaagaggggtccatgcagatgtttggaggggggggtcttaaagctttatttttagattacagcatattgcttttgcactatcataaagtaaaaacatcataagtcaagccaccataaatagcggaccatctgtatatctgaaagaagatgaaccaagacttggttattgttaaagctgatgattggctgtatgaagatttactatacaattttgtgtacttttgtaagttcttggttgtttctaaacttataacaaaataaataattggccatcttcattggattgtgaagccatttcctcccacatgttcgtaaaaatggtagccatggcccctgactgaacccaggtatgaatggccttcattgattttgtagaccctgaccttctctgttcttccagagaaggtggtactcagataaaaactttgaagcattttattgttcagaatatgactttgatcttctcataagactcaagtttttgaatgcttaaggctctttatcgctagtgtatgtaagtaatatcattgtccttaaccaccatctgcctctccccccagacacacataagtttatgataactacagaggtgtccagatgagtaaaaactgcctttgcattaaggtgagagaagaccgagatgaaatcttattagaaaatataactggggaaagcagtttgtctgtttctcctggaaaactactagactacatcaacttatatactacttcttttctatattctcaatatgagccacttaagaaaattaatgagactttatgtttgaccaaagctggtaattccttgatcttattctccaaacttgattctgaatgactactgaccactaaaaacactaagagtaccactgtggatgtttaaaaacatacaccctaagagccttcagaattagacgcttcaattcttctgaaatcaaaagtcacaccagctttgctgtagttaatcaggtaatacctttcttctccactactctctaatttccttgagggcaaatattgtctttcttgataaatgccctggacccaacatctaacagaatacctggcataaagtgaaatccatcgaatgtgctaatgataaataaagaagttcaaaaaaatcttttaatagaagctataaaatagcagataagctaagtcattctcataaaacaccatttgtcatttgaatgcgtgcattgtggcctgttacttttaactagtctcactaatttatagttatatatgatgtagatctagattgtgatgtacactaagtgggttgatcctgagatcaagctatgattgctgcttgcgtaaagtgttccttttgggaaataaataatctttcatatctgtaaactttggtataattggttatttatgcaatgtattgttgtggttgtcaactcaagattgtattctcatctggggacattatgaatcttgttattttatccccttttttgctctgttttttcacatttatggcctacctgttacagctgcacggtatccattttctgtgctaaattcatctttaatttattattttttttcaacctcagcttttaactttgccctgattttctcttccattttattttcacttccattttaagctggctcaaagccttttaggaacaataagttactgaattatatgaacctatttgaggtaatgatgatgcctgggaaggagcagtattgctggatcagaattcactttttccaagttacagattttaataaaccactgtgcaaagcattaggataaatttttattgaaaattgagtgaatgactgaacaaatcgctgggtaatgctgtttaggttgttctattttccacggattaaattaaattctatgta

SEQ ID NO: 185614 - DNA, 847 bp, Homo sapiens
  Payload ID: 16554
  Gene Symbol: SPATA17
  Gene Name: spermatogenesis associated 17
  ENST ID: ENST00000470448
  CDS Start-End: 56-298
cagttaccatggagaccggtagtaacaccagttgtaaacccaaggccaagagaccatggccacgttagcccggctgcaagctaggtcgtcgactgtaggaaatcagtactactttaggaacagtgttgtagatccatttagaaaaaaggagaatgatgcagcagttaaaatccaaagctggtttcgaggatgtcaagttcgggcatatatcaggcatttaaacaggattgtaacaattattcaaaaatggtggagaagtttcttaggcagaaagcaatatcaactaactgtgcagtgatctgaaatactcaagtgtgttagttacatcaatcagcccaattaggatgccttgctttaagcaattggaaactattgaaagtctatgatcttaaaaattcaaaaaaggagttgataaaagcaatactttacaaaattaatctagaagaactgttccaaatggattaaacagaagattaagcaggtagcatattatactatgatgatgaatctctacaatgcaatggctgtcaggattcagagacgatggcgaggctatagggttcggaagtacctctttaattattattatttgaaagagtacctgaaagtcgtttcagagaccaatgatgcaattaggcactggaggagtttgcagaaatgaaagaaagagaagagaagaaggctaacctcgaaagggaagagaagaaaagagattaccaagcccgaaagatgcattacctcctcagcacaaagcagattccaggaatatacaattcacccttcagaaaagagcctgatccatgggagctgcaattacagaaggcaaagcctttaacacaccgaagac

SEQ ID NO: 185615 - DNA, 4396 bp, Homo sapiens
  Payload ID: 16555
  Gene Symbol: SPATA18
  Gene Name: spermatogenesis associated 18
  Uniprot ID: Q8TC71
  ENST ID: ENST00000295213
  CDS Start-End: 375-1991
acccagggcggggcggcgcgggcgttgccacgacgcgggccgcgcgcgtccctggcagccaacccgtccacgtcaaggtttgtttaataatcgccagggtatctatggccgggctcaggcggctgctggggagccaggagaccgcgcgggacggcggatgaggcgcggcggctgcggcccagggcacctcccctctggcttcccgaacccggccaggtccgacccgagggggaggatggaaacacctgccgcgctctgagccccccagaagagaacacccttcccgccatatcaccccacggtcctgcggaggccaccgcctggtccccccaagtctccatcgcgcagcgtggggccgagaggaatagtgagcgatggcggaaaacctgaaaagactggtctcaaacgaaactttacgaacgttgcaggaaaagctagacttctggctgaaggagtacaacacaaacacgtgtgatcaaaatctaaaccattgccttgaactcattgagcaagttgccaaggtgcagggacaactctttgggatcctcacagcagcagcccaagaaggaggacgtaatgatggtgtggaaacaatcaagtcacgccttttgccttggctggaggcttcctttactgctgcttccctgggaaaatctgttgacagcaaggtcccctctctgcaggacacgtttgatagggagagacataaagatcccagtcctcgggatcgggatatgcaacagttagactctaatttgaactcaacccggagtcaatgcaaccaggttcaagacgatctggttgaaactgaaaagaatcttgaagaaagcaagaacagatcggccatatcccttttggctgcagaggaggaaataaatcagctgaaaaagcagcttaaatctcttcaagctcaggaggatgcccgccacagaaacacagatcagaggagctcagagaataggcggtcagagccttggagcttggaggagcggaagcgtgagcagtggaactcactcaagcagaatgcagaccagcaggacacagaagccatgtccgattataagaaacagctccgaaacctgaaggaggagatagctgttctgtctgctgagaaaagtgcactccaaggaaggtcctccaggagccggtctcccagccctgcccctcgcagccgtagctgcagccgcagcagatctgccagcccctccaccgctgtcaaggtcaggagaccgtccccaaaccgctccaagctgtccaatgtggcgcgcaaggctgccctcttgtcccggttcagcgattcctattcccaggcccgcctggacgcgcagtgcctgctgcggcgctgcatcgacaaggctgagaccgttcagcggatcatctacatcgccacagtggaggcattccatgtagcaaaaatggcattcagacacttcaagatccatgtgagaaaatcgttgacaccatcttatgtggggtcgaatgactttgagaatgctgtcttggattatgtcatttgtcatcttgatctatatgattctcaaagcagtgtcaatgatgtgatccgagccatgaatgtcaatcccaagatttcattccctcctgtcgttgacttttgccttctcagtgacttcatccaggagatatgttgcattgcctttgcaatgcaggccttagaaccacccctagatattgcatatggagcagatggagaagtttttaatgattgcaaataccgccgcagctacgactcggatttcactgctcccttagtcctctatcacgtgtggcctgctctcatggagaatgactgtgtcattatgaagggagaagctgtcaccaggagaggggctttttggaattcggtgcgatctgtaagtcgttgtcgaagcaggagtttaagtcccatttgcccccgtagccaaattggtttaaacacgatgtctcgaagtcggagtccttctccaataagatgtggattgccaagattttaaaagcaccagacctgctcctttgacccagtgcgtggaaacagctgctttctccagtgccgccatctgtcttctgtgtctgcctcagacctcacttaagataatgtcaaaaggcaattctgtgtatcaccccacacagagagttaaatgttttggcttggcgcatttgtaactttagatatattgcattctattttattttatagatactaattccattaatttcataaaaatgattgtataggcatttaggatcatattcattcgaagcaaagtccgttacaaaggttcaagatttccatctcaaaacactacgctcttttatgggaactgtgtgaactgaagtggaaagcatctaccatgctgaggctaaaagaaaagatgaatcattttagtttgcagatggatcgtaaatataattgttggtatcagctttagctcaaaaccaatattaggtgttttaatttccttttaaggtttggaagacagccctaatctcaggttggggagctcatgttagtagcagtgacttaaggctaagtgtagaagataatttaagatacattttctttatatattagccaacaaattatatttattggttggcttgcttttccgttctgattttgagagtgcccagtttggtttagttgaccaatgaatgtcaaagctacttagttgagagaatttccttgttcataaatgtagagcagtgatttgattagaagccagctttgagataaatgttaattacctcatgcatatctcctgggaatatttcaaactgttttaatgcatgtgttatatataaaagtttcttgggacatgctcttcacctgttctacctagttatttgcaaattcagacctcctattgaactctgtctgaccaaaactacttaaactcaaggcccaaaactaggggcaccatttactgattttaaattgagtatatatcccttgacttcttcactgtcaaatacttttgaaacttcacgttcaagataagaatggaatgttgctttcttgcaataagtaatgttctttctgcctttttttcacttttaagtcagccttaaacacatgcctcacaaacatctactttctccacatacctttgagagagacactgaattggcctcagctcagttttgcataagcttagtgccagaaccagcacctgatgcttttcaggtgaaaataaaacaaacagcttctctaaagcatcttacccctgtgctggaggtttgagggacctcttcagtgcctgccccttgagtctaatggtcaccacctcattctgaagtatgagttgaattttttgccctctttgcatatttacattagtcatcactttgaagcaatgcagtgtgctggaaggagcactatctgcctaggtaactgctagtcatgacttggtcatcagcttgctttgtggcactgagcaagttacttcacttctctgagccttggttttatcatagggtgaggaggttggatacaattagtgcccctcttaaccctgcagactcaatgttcccttttataacaagtattttattctgaatatgaaatgaaaattaaagttaatataatcatctatgtgcatgtataattttaagcagtgaacatagtaccctaactataatataaagcagaaaaaaaggcaacttttaataaaataaaatgtatttcaataaaaaagcttgggtataaccaccctagaagataaaattaagtcattagatggctgaacctgcatgtagagccaccagctacaaatgaaaatcaatgtgtgtattggcaacagaaaatcacggtgttgtcattggatgtgactttctgaagtggtgggcaattcttgttaatgttttaaacaaaaaaaaaaaaaccttacagtcttgccctgatttacacagcagtcacattcctggaaaattcaagtgtttattaaaactatgcaacagttactgtgtgttatacgttgaaaggtcttcactaatatctcactaagtaatgagaatgcctacatatcagaattttttttttcaggagccaagcacatatactgatttggaaaaaggcacaggtagctcagtttatttgctttctaccctgcctggccacttgctgtttcttcagtttctaatttgagctgtaactacacaaggaaagctaaatagtctggaaaatttttggaaagaatccacaaagccaaaggagactggcctatactcattttatctggggatgtaccttacccttagagactttgaaaaatgtgaagctcttattttgtaacctgggtaaatgttagtttctagattttcggcttaacatctaataataacatttaaaaagtgcttttgtaactattagttatttgcaataaaatgctttccttctaca

SEQ ID NO: 185616 - DNA, 2816 bp, Homo sapiens
  Payload ID: 16555
  Gene Symbol: SPATA18
  Gene Name: spermatogenesis associated 18
  Uniprot ID: Q8TC71
  ENST ID: ENST00000419395
  CDS Start-End: 290-1810
aataatcgccagggtatctatggccgggctcaggcggctgctggggagccaggagaccgcgcgggacggcggatgaggcgcggcggctgcggcccagggcacctcccctctggcttcccgaacccggccaggtccgacccgagggggaggatggaaacacctgccgcgctctgagccccccagaagagaacacccttcccgccatatcaccccacggtcctgcggaggccaccgcctggtccccccaagtctccatcgcgcagcgtggggccgagaggaatagtgagcgatggcggaaaacctgaaaagactggtctcaaacgaaactttacgaacgttgcaggaaaagctagacttctggctgaaggagtacaacacaaacacgtgtgatcaaaatctaaaccattgccttgaactcattgagcaagttgccaaggtgcagggacaactctttgggatcctcacagcagcagcccaagaaggaggacgtaatgatggtgtggaaacaatcaagtcacgccttttgccttggctggaggcttcctttactgctgcttccctgggaaaatctgttgacagcaaggtcccctctctgcaggacacgtttgatagggagagacataaagatcccagtcctcgggatcgggatatgcaacagttagactctaatttgaactcaacccggagtcaatgcaaccaggttcaagacgagcttaaatctcttcaagctcaggaggatgcccgccacagaaacacagatcagaggagctcagagaataggcggtcagagccttggagcttggaggagcggaagcgtgagcagtggaactcactcaagcagaatgcagaccagcaggacacagaagccatgtccgattataagaaacagctccgaaacctgaaggaggagatagctgttctgtctgctgagaaaagtgcactccaaggaaggtcctccaggagccggtctcccagccctgcccctcgcagccgtagctgcagccgcagcagatctgccagcccctccaccgctgtcaaggtcaggagaccgtccccaaaccgctccaagctgtccaatgtggcgcgcaaggctgccctcttgtcccggttcagcgattcctattcccaggcccgcctggacgcgcagtgcctgctgcggcgctgcatcgacaaggctgagaccgttcagcggatcatctacatcgccacagtggaggcattccatgtagcaaaaatggcattcagacacttcaagatccatgtgagaaaatcgttgacaccatcttatgtggggtcgaatgactttgagaatgctgtcttggattatgtcatttgtcatcttgatctatatgattctcaaagcagtgtcaatgatgtgatccgagccatgaatgtcaatcccaagatttcattccctcctgtcgttgacttttgccttctcagtgacttcatccaggagatatgttgcattgcctttgcaatgcaggccttagaaccacccctagatattgcatatggagcagatggagaagtttttaatgattgcaaataccgccgcagctacgactcggatttcactgctcccttagtcctctatcacgtgtggcctgctctcatggagaatgactgtgtcattatgaagggagaagctgtcaccaggagaggggctttttggaattcggtgcgatctgtaagtcgttgtcgaagcaggagtttaagtcccatttgcccccgtagccaaattggtttaaacacgatgtctcgaagtcggagtccttctccaataagatgtggattgccaagattttaaaagcaccagacctgctcctttgacccagtgcgtggaaacagctgctttctccagtgccgccatctgtcttctgtgtctgcctcagacctcacttaagataatgtcaaaaggcaattctgtgtatcaccccacacagagagttaaatgttttggcttggcgcatttgtaactttagatatattgcattctattttattttatagatactaattccattaatttcataaaaatgattgtataggcatttaggatcatattcattcgaagcaaagtccgttacaaaggttcaagatttccatctcaaaacactacgctcttttatgggaactgtgtgaactgaagtggaaagcatctaccatgctgaggctaaaagaaaagatgaatcattttagtttgcagatggatcgtaaatataattgttggtatcagctttagctcaaaaccaatattaggtgttttaatttccttttaaggtttggaagacagccctaatctcaggttggggagctcatgttagtagcagtgacttaaggctaagtgtagaagataatttaagatacattttctttatatattagccaacaaattatatttattggttggcttgcttttccgttctgattttgagagtgcccagtttggtttagttgaccaatgaatgtcaaagctacttagttgagagaatttccttgttcataaatgtagagcagtgatttgattagaagccagctttgagataaatgttaattacctcatgcatatctcctgggaatatttcaaactgttttaatgcatgtgttatatataaaagtttcttgggacatgctcttcacctgttctacctagttatttgcaaattcagacctcctattgaactctgtctgaccaaaactacttaaactcaaggcccaaaactaggggcaccatttactgattttaaattgagtatatatcccttgacttcttcactgtcaaatacttttgaaacttcacgttcaagataaga

SEQ ID NO: 185617 - DNA, 1911 bp, Homo sapiens
  Payload ID: 16555
  Gene Symbol: SPATA18
  Gene Name: spermatogenesis associated 18
  ENST ID: ENST00000505320
  CDS Start-End: 245-1795
gagccaggagaccgcgcgggacggcggatgaggcgcggcggctgcggcccagggcacctcccctctggcttcccgaacccggccaggtccgacccgagggggaggatggaaacacctgccgcgctctgagccccccagaagagaacacccttcccgccatatcaccccacggtcctgcggaggccaccgcctggtccccccaagtctccatcgcgcagcgtggggccgagaggaatagtgagcgatggcggaaaacctgaaaagactggtctcaaacgaaactttacgaacgttgcaggaaaagctagacttctggctgaaggagtacaacacaaacacgtgtgatcaaaatctaaaccattgccttgaactcattgagcaagttgccaaggtgcagggacaactctttgggatcctcacagcagcagcccaagaaggaggacgtaatgatggtgtggaaacaatcaagtcacgccttttgccttggctggaggcttcctttactgctgcttccctgggaaaatctgttgacagcaaggtcccctctctgcaggacacgtttgatagggagagacataaagatcccagtcctcgggatcgggatatgcaacagttagactctaatttgaactcaacccggagtcaatgcaaccaggttcaagacgatctggttgaaactgaaaagaatcttgaagaaagcaagaacagatcggccatatcccttttggctgcagaggaggaaataaatcagctgaaaaagcagcttaaatctcttcaagctcaggaggatgcccgccacagaaacacagatcagaggagctcagagaataggcggtcagagccttggagcttggaggagcggaagcgtgagcagtggaactcactcaagcagaatgcagaccagcaggacacagaagccatgtccgattataagaaacagctccgaaacctgaaggaggagatagctgttctgtctgctgagaaaagtgcactccaaggaaggtcctccaggagccggtctcccagccctgcccctcgcagccgtagctgcagccgcagcagatctgccagcccctccaccgctgtcaaggtcaggagaccgtccccaaaccgctccaagctgtccaatgtggcgcgcaaggctgccctcttgtcccggttcagcgattcctattcccaggcccgcctggacgcgcagtgcctgctgcggcgctgcatcgacaaggctgagaccgttcagcggatcatctacatcgccacagtggaggcattccatgtagcaaaaatggcattcagacacttcaagatccatgtgagaaaatcgttgacaccatcttatgtggggtcgaatgactttgagaatgctgtcttggattatgtcatttgtcatcttgatctatatgattctcaaagcagtgtcaatgatgtgatccgagccatgaatgtcaatcccaagatttcattccctcctgtcgttgacttttgccttctcagtgacttcatccaggagatatgttgcattgcctttgcaatgcaggccttagaaccacccctagatattgcatatggagcagatggagaagtttttaatgattgcaaataccgccgcagctacgactcggatttcactgctcccttagtcctctatcacgtgtggcctgctctcatggagaatgactgtgtcattatgaagggagaagctgtcaccaggagaggggcttttgtacggtggccttgcatagtgacaattcatcccaagtgtttgattcacaatggaattcggtgcgatctgtaagtcgttgtcgaagcaggagtttaagtcccatttgcccccgtagccaaattggtttaaacacgatgtctcgaagtcggagtccttctccaataagatgtggattgccaagattttaa

SEQ ID NO: 185618 - DNA, 588 bp, Homo sapiens
  Payload ID: 16555
  Gene Symbol: SPATA18
  Gene Name: spermatogenesis associated 18
  ENST ID: ENST00000505038
  CDS Start-End: 164-478
gccaggtccgacccgagggggaggatggaaacacctgccgcgctctgagccccccagaagagaacacccttcccgccatatcaccccacggtcctgcggaggccaccgcctggtccccccaagtctccatcgcgcagcgtggggccgagaggaatagtgagcgatggcggaaaacctgaaaagactggtctcaaacgaaactttacgaacgttgcaggaaaagctagacttctggctgaaggagtacaacacaaacacgtgtgatcaaaatctaaaccattgccttgaactcattgagcaagttgccaaggtgcagggacaactctttgggatcctcacagcagcagcccaagaaggaggacgtaatgatggtgtggaaacaatcaagtcacgccttttgccttggctggaggcttcctttactgctgcttccctgggaaaatctgttgacagcaaggtcccctctctgcaggcttaaatctcttcaagctcaggaggatgcccgccacagaaacacagatcagaggagctcagagaataggcggtcagagccttggagcttggaggagcggaagcgtgagcagtgga

SEQ ID NO: 185619 - DNA, 552 bp, Homo sapiens
  Payload ID: 16555
  Gene Symbol: SPATA18
  Gene Name: spermatogenesis associated 18
  ENST ID: ENST00000503055
  CDS Start-End: 245-511
gagccaggagaccgcgcgggacggcggatgaggcgcggcggctgcggcccagggcacctcccctctggcttcccgaacccggccaggtccgacccgagggggaggatggaaacacctgccgcgctctgagccccccagaagagaacacccttcccgccatatcaccccacggtcctgcggaggccaccgcctggtccccccaagtctccatcgcgcagcgtggggccgagaggaatagtgagcgatggcggaaaacctgaaaagactggtctcaaacgaaactttacgaacgttgcaggaaaagctagacttctggctgaaggagtacaacgaggacgtaatgatggtgtggaaacaatcaagtcacgccttttgccttggctggaggcttcctttactgctgcttccctgggaaaatctgttgacagcaaggtcccctctctgcaggacacgtttgatagggagagacataaagatcccagtcctcgggatcgggatatgcaacagttagactctaatttgaactcaacccggagtcaatgcaaccaggtt

SEQ ID NO: 185620 - DNA, 569 bp, Homo sapiens
  Payload ID: 16555
  Gene Symbol: SPATA18
  Gene Name: spermatogenesis associated 18
  ENST ID: ENST00000508915
  CDS Start-End: 290-385
aataatcgccagggtatctatggccgggctcaggcggctgctggggagccaggagaccgcgcgggacggcggatgaggcgcggcggctgcggcccagggcacctcccctctggcttcccgaacccggccaggtccgacccgagggggaggatggaaacacctgccgcgctctgagccccccagaagagaacacccttcccgccatatcaccccacggtcctgcggaggccaccgcctggtccccccaagtctccatcgcgcagcgtggggccgagaggaatagtgagcgatggcggaaaacctgaaaagactggtctcaaacgaaactttacgaacgttgcaggaaaagctagacttctggctgaaggagtacaactctggttgaaactgaaaagaatcttgaagaaagcaagaacagatcggccatatcccttttggctgcagaggaggaaataaatcagctgaaaaagcagcttaaatctcttcaagctcaggaggatgcccgccacagaaacacagatcagaggagctcagagaataggcggtcagagccttggagcttggaggag

SEQ ID NO: 185621 - DNA, 861 bp, Homo sapiens
  Payload ID: 16556
  Gene Symbol: SPATA19
  Gene Name: spermatogenesis associated 19
  Uniprot ID: Q7Z5L4
  ENST ID: ENST00000299140
  CDS Start-End: 56-559
aggcagcttcaatggaaggagggagccaagaagggggcctggtatacattcaaagatgataattacgacatggattgtgtatattcttgctcggaaaggtgtagggcttcccttcctaccaataaccagttcggacattgacgttgtggaaagtgaggctgtgtctgtactacatcattggttgaaaaaaacagaagaagaggcttctcggggcataaaggaaaagctgtccatcaaccacccttcccagggtgtaagggagaagatgtccactgactcccctcccacccatggccaggacatccacgtgaccagagatgtggtgaagcaccacctctctaagtctgatttgttggcaaaccagagccaagaggtcctagaggagagaacacgaatccagttcataagatggagccacactcgtatcttccaagtgccaagtgagatgacagaggacatcatgcgagatcgaatagagcaggtgagacgaagcatatcccgtcttacagatgtctcagctcaggacttcagtatgagaccctcctcctcagactgctgagagcaacagatggagctttgggaacgcggagaacagtggggttacagggagtcatcatcagccctaccccttggccaaccacatctccctgctgtgtcccctgggcatttctctacctcccaggtggaagtccttcagggtccagcagcaacctgtatcagaagaacatccttctctgcttgacctgaagaagggccagacctgggcagaaagactccagcaggtgagctcttcatgcgacagtgtcagcactggagtcttcttgctgaactgcgaataaagagatgtgctgtttaacaacc

SEQ ID NO: 185622 - DNA, 653 bp, Homo sapiens
  Payload ID: 16556
  Gene Symbol: SPATA19
  Gene Name: spermatogenesis associated 19
  Uniprot ID: Q7Z5L4
  ENST ID: ENST00000532889
  CDS Start-End: 93-596
ctcccttcaatgaccttcctgtcccataggagttctcaggcagcttcaatggaaggagggagccaagaagggggcctggtatacattcaaagatgataattacgacatggattgtgtatattcttgctcggaaaggtgtagggcttcccttcctaccaataaccagttcggacattgacgttgtggaaagtgaggctgtgtctgtactacatcattggttgaaaaaaacagaagaagaggcttctcggggcataaaggaaaagctgtccatcaaccacccttcccagggtgtaagggagaagatgtccactgactcccctcccacccatggccaggacatccacgtgaccagagatgtggtgaagcaccacctctctaagtctgatttgttggcaaaccagagccaagaggtcctagaggagagaacacgaatccagttcataagatggagccacactcgtatcttccaagtgccaagtgagatgacagaggacatcatgcgagatcgaatagagcaggtgagacgaagcatatcccgtcttacagatgtctcagctcaggacttcagtatgagaccctcctcctcagactgctgagagcaacaggtggaagtccttcagggtccagcagcaacctgtatcagaagaacatcc

SEQ ID NO: 185623 - DNA, 4022 bp, Homo sapiens
  Payload ID: 16557
  Gene Symbol: SPATA2
  Gene Name: spermatogenesis associated 2
  Uniprot ID: Q9UM82
  ENST ID: ENST00000289431
  CDS Start-End: 232-1794
cccgggtactggtctcagtacccctgcagccggccggagaggctagagcccgacggggcccggctccggcggcagccgcgcctctcgcttgcttccctcggccgggccgtcctcggcggcagtgtcaggagcactccgctggtccaggcggcaacatgtccatgcttttagtgatgtccctgcctctaatccagaagccatggaggagataaggtagcccccctcgatcggatggggaagcccagttcaatggatactaaattcaaggatgacttatttcggaagtacgtgcagttccatgagagcaaagtggataccaccaccagcaggcagcggcctggcagcgatgagtgcctgcgggtggcagcctcaaccctgctcagcctgcacaaggtggatcccttttatcgattccggctgatccagttctatgaggtggtggagagctccttgcgctcgctcagctcctctagcctgcgggctctgcacggcgccttcagcatgctggagacggtgggcatcaacctcttcctctacccgtggaagaaggaattcagaagcatcaagacctacacgggcccttttgtttattatgtcaagtcgacattactggaagaggacatccgagccatcctgagctgcatgggctacacacctgagctgggcactgcatacaagctcagagagctcgtggagaccctccaggtgaagatggtctcctttgagctctttctggccaaagtcgagtgtgagcagatgctagaaatccactcacaagtgaaggacaagggctactccgagctggacattgtgagcgagcgcaagagcagtgcagaggatgtgcgcggctgctcggacgccctgcggcggcgggcagagggccgggagcacctgacggcctccatgtcacgagtggcactccagaagtcggccagcgagcgggcggccaaggactactacaagccccgcgtgaccaagccctcgaggtcagtggatgcctatgacagctactgggagagccggaagccacccctgaaggcctcattgagtcttcggaaggagcctgtggcaacggatgtgggggacgacctcaaggatgagatcatccgcccatccccttcgctgctgaccatggccagctccccccacggcagcccggatgtgcttccacccgcctcccccagcaacggcccggccctgctgcgcggtacctacttctccactcaggatgacgtggatctgtacacagactctgaacccagggccacctaccgtcggcaggatgctctgcggccggatgtgtggctgctcagaaacgatgcccactccctctaccacaagcgctcgccccctgccaaagagtccgccctctccaagtgccaaagctgcgggctgtcctgcagctcctccctctgccagcgctgtgacagcctgctcacctgtcctccagcttccaagcccagcgccttccccagcaaggcctcgactcatgacagcctggcccacggggcatctctgcgggagaagtacccaggccagactcagggcctcgaccgcctcccgcaccttcactccaaatccaagccctccaccacgcccacttcccgctgtggcttctgcaaccgcccaggcgccaccaacacctgcacccagtgttcaaaagtctcatgtgacgcctgcctcagcgcttaccattatgacccctgctacaaaaagagtgagctgcacaagttcatgcccaacaaccagctgaactacaagtccacccagctctcccatctcgtgtacagatagaccggcctcgccccttccagctccaagggctacatcaaccgacctttcgggtttcacggtgaagaagtactaacgcattgatctcagaggcggaggcctgcacttgaccatgtaggtggcagagatcgtgggctggctgtgtccacgtgggagttcacttagcgactcagatatctcaaccaatggctgctttgttgtctgacaagggagaaggtggcacttccgttcagattcattttgctaatctctccactccctgttcagttggttctttttttggggttttgttttgttttgttttgttgttttgttttttcctttaaagaggatttctgtctctgggaccctcgctgcacctacccctcccattgcaaagccaacttggactgggaagggcccttcaggtcaccaaacatccacctggagcggcgagctagaggcctgttggcttgtgaaatgagccctcctgccacacggggcctctcccaaaggctcatcccttggccgcccccttcctaaacacaaggatccccagctggactccccaccccctggcttccccacctctccaggtgtcaaaggtgaaccgagtccagtattagctgaatgtcatttcgtacaccacagctcagtcagcccatggccttcgtgaactttgctccaacacactgatgtgtgggcttcccacagcaggactgacttccccctttctgttgtttgcacatgcccctcttactgtactgtcaatagatatttttgagatttatttttaaataaatattcaacttgctgtgtgtttcaacgtggttaaaaaaatgaattatgtagctatttattaaatgccctgggttctttagtcttccaagggagggcctcgcgcccattcgtgttgtatcctccactcactatggcccgaggggagaggagagtttggggcagggaggaacagacatgaagcctccttttcttgagctggtggagagccactgtcttccctgcagtaactatctatacacctacctccagtgtgcacttagggggtgagcgcgggtgtcgaggtctgtgtgtctgcagactgctaacctatgacaattcagggacctcacctgtcggacctatagcttgctgagcaggaaccttgcacttcacacttcttgagtctcgtttcagaaggaaaatcatttgggattcctactgcccctccatctcaatcctcttctcttcaccagtttccaggactcatctgcaacatttgcaatctttttgcactaaaagtgggcaggagtcggcatgtgcccatcagagagacggctcctcagatgctcagctaagcctaagcgcttccaagcctgaaggccccttcagcttctcatgtgaattaccaacccctggattttccttgtgggggtacaagagcaggagtggggcaagagtttgaaaataaagccgcttccttgtgaactaactatattttagccataactgtttgtgatgtacacaatgttaagggatttatatgcagtgggcttttctgggagaaagttattcagctcttgagcaagtttaagtctggctgaatcctgaggccactgtgaatttgctgatgttcttccaactcagttgagtgattttaaggttttccaaatcttctatggctctctttttaatatatatatatatatatatatatatatatatatatatatatatatatatctatctggtagatcacatgtagatgtacagtgtgtatattaagctgaatttcaaccaactttattactaagaccagcctagcagggcattcatctttgatgttcttccttttcacatttcagaatcggcaatgcctggcccactcctgagagctctagttttctagttttccatttccagattgcgccagcattacagtaactaactctttctaaccaaccgtgatgccacgtaacttaccctatggacaaaagcaggaatgactaacacatcctaggagggaaagtccagtgtacctgtcatcacggacgcactgtggtcacagactggaatacgaaatactacagccctgctcccaggtgtgcatcttactggatgaggttgctgtgattgagatagttaaatacatgctaatttaaaaatgcagatgttttacatttgatttctaccaagagttgaaatgttgagagatgattaaaaataataataataaagtgtcttccattgttaaa

SEQ ID NO: 185624 - DNA, 4138 bp, Homo sapiens
  Payload ID: 16557
  Gene Symbol: SPATA2
  Gene Name: spermatogenesis associated 2
  Uniprot ID: Q9UM82
  ENST ID: ENST00000422556
  CDS Start-End: 351-1913
gagcttacatcatatagagattagctctcctagccccattcggtgtgggaagatgggaattttgctactacaggaatttttgtaactcaactctgctcgcgccgccataaggcattctaacttagccaaacactttcgagtagagctgtccagcagatgcagcaggatggctttgcaagagtcggagttttggcgttagacctaggttcagagctcagatccacttcttcctagccttacgacttaggagcactccgctggtccaggcggcaacatgtccatgcttttagtgatgtccctgcctctaatccagaagccatggaggagataaggtagcccccctcgatcggatggggaagcccagttcaatggatactaaattcaaggatgacttatttcggaagtacgtgcagttccatgagagcaaagtggataccaccaccagcaggcagcggcctggcagcgatgagtgcctgcgggtggcagcctcaaccctgctcagcctgcacaaggtggatcccttttatcgattccggctgatccagttctatgaggtggtggagagctccttgcgctcgctcagctcctctagcctgcgggctctgcacggcgccttcagcatgctggagacggtgggcatcaacctcttcctctacccgtggaagaaggaattcagaagcatcaagacctacacgggcccttttgtttattatgtcaagtcgacattactggaagaggacatccgagccatcctgagctgcatgggctacacacctgagctgggcactgcatacaagctcagagagctcgtggagaccctccaggtgaagatggtctcctttgagctctttctggccaaagtcgagtgtgagcagatgctagaaatccactcacaagtgaaggacaagggctactccgagctggacattgtgagcgagcgcaagagcagtgcagaggatgtgcgcggctgctcggacgccctgcggcggcgggcagagggccgggagcacctgacggcctccatgtcacgagtggcactccagaagtcggccagcgagcgggcggccaaggactactacaagccccgcgtgaccaagccctcgaggtcagtggatgcctatgacagctactgggagagccggaagccacccctgaaggcctcattgagtcttcggaaggagcctgtggcaacggatgtgggggacgacctcaaggatgagatcatccgcccatccccttcgctgctgaccatggccagctccccccacggcagcccggatgtgcttccacccgcctcccccagcaacggcccggccctgctgcgcggtacctacttctccactcaggatgacgtggatctgtacacagactctgaacccagggccacctaccgtcggcaggatgctctgcggccggatgtgtggctgctcagaaacgatgcccactccctctaccacaagcgctcgccccctgccaaagagtccgccctctccaagtgccaaagctgcgggctgtcctgcagctcctccctctgccagcgctgtgacagcctgctcacctgtcctccagcttccaagcccagcgccttccccagcaaggcctcgactcatgacagcctggcccacggggcatctctgcgggagaagtacccaggccagactcagggcctcgaccgcctcccgcaccttcactccaaatccaagccctccaccacgcccacttcccgctgtggcttctgcaaccgcccaggcgccaccaacacctgcacccagtgttcaaaagtctcatgtgacgcctgcctcagcgcttaccattatgacccctgctacaaaaagagtgagctgcacaagttcatgcccaacaaccagctgaactacaagtccacccagctctcccatctcgtgtacagatagaccggcctcgccccttccagctccaagggctacatcaaccgacctttcgggtttcacggtgaagaagtactaacgcattgatctcagaggcggaggcctgcacttgaccatgtaggtggcagagatcgtgggctggctgtgtccacgtgggagttcacttagcgactcagatatctcaaccaatggctgctttgttgtctgacaagggagaaggtggcacttccgttcagattcattttgctaatctctccactccctgttcagttggttctttttttggggttttgttttgttttgttttgttgttttgttttttcctttaaagaggatttctgtctctgggaccctcgctgcacctacccctcccattgcaaagccaacttggactgggaagggcccttcaggtcaccaaacatccacctggagcggcgagctagaggcctgttggcttgtgaaatgagccctcctgccacacggggcctctcccaaaggctcatcccttggccgcccccttcctaaacacaaggatccccagctggactccccaccccctggcttccccacctctccaggtgtcaaaggtgaaccgagtccagtattagctgaatgtcatttcgtacaccacagctcagtcagcccatggccttcgtgaactttgctccaacacactgatgtgtgggcttcccacagcaggactgacttccccctttctgttgtttgcacatgcccctcttactgtactgtcaatagatatttttgagatttatttttaaataaatattcaacttgctgtgtgtttcaacgtggttaaaaaaatgaattatgtagctatttattaaatgccctgggttctttagtcttccaagggagggcctcgcgcccattcgtgttgtatcctccactcactatggcccgaggggagaggagagtttggggcagggaggaacagacatgaagcctccttttcttgagctggtggagagccactgtcttccctgcagtaactatctatacacctacctccagtgtgcacttagggggtgagcgcgggtgtcgaggtctgtgtgtctgcagactgctaacctatgacaattcagggacctcacctgtcggacctatagcttgctgagcaggaaccttgcacttcacacttcttgagtctcgtttcagaaggaaaatcatttgggattcctactgcccctccatctcaatcctcttctcttcaccagtttccaggactcatctgcaacatttgcaatctttttgcactaaaagtgggcaggagtcggcatgtgcccatcagagagacggctcctcagatgctcagctaagcctaagcgcttccaagcctgaaggccccttcagcttctcatgtgaattaccaacccctggattttccttgtgggggtacaagagcaggagtggggcaagagtttgaaaataaagccgcttccttgtgaactaactatattttagccataactgtttgtgatgtacacaatgttaagggatttatatgcagtgggcttttctgggagaaagttattcagctcttgagcaagtttaagtctggctgaatcctgaggccactgtgaatttgctgatgttcttccaactcagttgagtgattttaaggttttccaaatcttctatggctctctttttaatatatatatatatatatatatatatatatatatatatatatatatatatctatctggtagatcacatgtagatgtacagtgtgtatattaagctgaatttcaaccaactttattactaagaccagcctagcagggcattcatctttgatgttcttccttttcacatttcagaatcggcaatgcctggcccactcctgagagctctagttttctagttttccatttccagattgcgccagcattacagtaactaactctttctaaccaaccgtgatgccacgtaacttaccctatggacaaaagcaggaatgactaacacatcctaggagggaaagtccagtgtacctgtcatcacggacgcactgtggtcacagactggaatacgaaatactacagccctgctcccaggtgtgcatcttactggatgaggttgctgtgattgagatagttaaatacatgctaatttaaaaatgcagatgttttacatttgatttctaccaagagttgaaatgttgagagatgattaaaaataataataataaagtgtcttccattgtt

SEQ ID NO: 185625 - DNA, 2719 bp, Homo sapiens
  Payload ID: 16558
  Gene Symbol: SPATA20
  Gene Name: spermatogenesis associated 20
  Uniprot ID: Q8TB22
  ENST ID: ENST00000006658
  CDS Start-End: 121-2529
acactgtcccaagtcccggcgaagacccgcccgcggctccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaagctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 185626 - DNA, 2634 bp, Homo sapiens
  Payload ID: 16558
  Gene Symbol: SPATA20
  Gene Name: spermatogenesis associated 20
  Uniprot ID: Q8TB22
  ENST ID: ENST00000356488
  CDS Start-End: 84-2444
tccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaagctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 185627 - DNA, 879 bp, Homo sapiens
  Payload ID: 16558
  Gene Symbol: SPATA20
  Gene Name: spermatogenesis associated 20
  ENST ID: ENST00000502911
  CDS Start-End: 57-227
agcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtgtcctggagtctggcccaggacctggccccacaggagtcccagcaggcccaggaggttgggggagactaacctggcaaggagcccccaatgagccacctctcctcaccccccaaaaaacataagggggagcacaaaggccacagtctcccccatggttcagaaaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgt

SEQ ID NO: 185628 - DNA, 453 bp, Homo sapiens
  Payload ID: 16558
  Gene Symbol: SPATA20
  Gene Name: spermatogenesis associated 20
  ENST ID: ENST00000510917
  CDS Start-End: 49-180
gacttcccttcctgtcctcagcggccgggcccacggccccgagcagccatgctgggcgcgcgggcctggttgggccgcgtccttctgctgccccgcgccggtgcaggcctcgccgcgagccgcaggtctgcctgcagtcccacttccaggctgaactccctgaggtctctgattccctaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactgtcgggtactccacctgccactggtgccacatgatggaagaggagtccttccaga

SEQ ID NO: 185629 - DNA, 3539 bp, Homo sapiens
  Payload ID: 16558
  Gene Symbol: SPATA20
  Gene Name: spermatogenesis associated 20
  ENST ID: ENST00000504334
  CDS Start-End: 796-927
agcaaatattgactgactgctgtggacaaagtgctgggctcaccttggagggatccaacctccaggagctcgagcgcagcagggtagacaagccaggggcacgtgatgcggctgtggcagaagccaagtgcaggagctcccaggctcctttgttttactgagtcaccttaaatgtaactctgccctctcccttgcttcgccaaggctagcgagaaactcagtcttagccacacaggaggaatcggaccccttctgggggtttatgtggagtctgggaaaccaagggtggggtgaggcctggtactcaatccaggaggggcccctatgaccaccctcgcctgtttttcttctcaatgctccctgatcactggaccactggacactgatgtgtcctcagtgcttggggtctggctctgcaggcagcctgcagccagcctccatccccctttcagggacaaatggccttccaccagagtcgttgctcagcccggactcactgacaagccacgggacctttgcacaaactgtacctctgcctccttccccagcactccccctgagcaccctccaagttcctttctctcgttctccatggcttcacaaatgtgatttcctcagggaagccttcatcctttgccccttccaccagatcagggcgacgctcggagaccagccacactgtcccaagtcccggcgaagacccgcccgcggctccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtctgcctgcagtcccacttccaggctgaactccctgaggtctctgattccctaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcaggtgacgggcactgggtgttccctggaggggcagcagggggctgtggggtggggcagaagctgggactggcctccagctttgtatccgcacagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaagctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggt

SEQ ID NO: 185630 - DNA, 1035 bp, Homo sapiens
  Payload ID: 16558
  Gene Symbol: SPATA20
  Gene Name: spermatogenesis associated 20
  ENST ID: ENST00000511347
  CDS Start-End: 1-742
ggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgcttt

SEQ ID NO: 185631 - DNA, 512 bp, Homo sapiens
  Payload ID: 16558
  Gene Symbol: SPATA20
  Gene Name: spermatogenesis associated 20
  ENST ID: ENST00000508528
  CDS Start-End: 1-332
accaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggg

SEQ ID NO: 185632 - DNA, 1590 bp, Homo sapiens
  Payload ID: 16558
  Gene Symbol: SPATA20
  Gene Name: spermatogenesis associated 20
  ENST ID: ENST00000505559
  CDS Start-End: 5-136
agccatgctgggcgcgcgggcctggttgggccgcgtccttctgctgccccgcgccggtgcaggcctcgccgcgagccgcaggtctgcctgcagtcccacttccaggctgaactccctgaggtctctgattccctaggtgtcctggagtctggcccaggacctggccccacaggagtcccagcaggtgggcgctgagtgagggagtccccatgtctggtttcctctgtttgtccctcacctggtcgagtcccagaccctactgatcttggcctgtccagccaccaacagtaggctgccttccagtggggccacacccaggcctgccagagagatgcctccaagcagctgctccaggaagggccgggggaggggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtgatcctgagcttcctgttctcctactggctcagccatcgactgactcaggatggctctcgggcccagcagatggccttgcataccctgaaaatgatggctaacgggggcatccgggaccatgtggggcaggtgacgggcactgggtgttccctggaggggcagcagggggctgtggggtggggcagaagctgggactggcctccagctttgtatccgcacagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccgggtgtgtgtccatggtggcaggcaggcctggctgtgggaggggttggggcctccactgccctgtgggccggggccagccaactctcccctccccacagtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacag

SEQ ID NO: 185633 - DNA, 2734 bp, Homo sapiens
  Payload ID: 16558
  Gene Symbol: SPATA20
  Gene Name: spermatogenesis associated 20
  ENST ID: ENST00000503127
  CDS Start-End: 83-214
ccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtctgcctgcagtcccacttccaggctgaactccctgaggtctctgattccctaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaagctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggt

SEQ ID NO: 185634 - DNA, 878 bp, Homo sapiens
  Payload ID: 16558
  Gene Symbol: SPATA20
  Gene Name: spermatogenesis associated 20
  ENST ID: ENST00000505456
  CDS Start-End: 26-157
gccgggcccacggccccgagcagccatgctgggcgcgcgggcctggttgggccgcgtccttctgctgccccgcgccggtgcaggcctcgccgcgagccgcaggtctgcctgcagtcccacttccaggctgaactccctgaggtctctgattccctaggtgtcctggagtctggcccaggacctggccccacaggagtcccagcaggcccaggaggttgggggagactaacctggcaaggagcccccaatgagccacctctcctcaccccccaaaaaacataagggggagcacaaaggccacagtctcccccatggttcagaaaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaaca

SEQ ID NO: 185635 - DNA, 628 bp, Homo sapiens
  Payload ID: 16558
  Gene Symbol: SPATA20
  Gene Name: spermatogenesis associated 20
  ENST ID: ENST00000505085
  CDS Start-End: 81-284
gtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtgtcctggagtctggcccaggacctggccccacaggagtcccagcaggtgggcgctgagtgagggagtccccatgtctggtttcctctgtttgtccctcacctggtcgagtcccagaccctactgatcttggcctgtccagccaccaacagtaggctgccttccagtggggccacacccaggcctgccagagagatgcctccaagcagctgctccaggaagggccgggggaggggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcag

SEQ ID NO: 185636 - DNA, 2769 bp, Homo sapiens
  Payload ID: 16558
  Gene Symbol: SPATA20
  Gene Name: spermatogenesis associated 20
  Uniprot ID: Q8TB22
  ENST ID: ENST00000619622
  CDS Start-End: 353-2581
acactgtcccaagtcccggcgaagacccgcccgcggctccgtaggtgcccggcccgcccctcgcagcctcctgacttcccttcctgtcctcagcggccgggcccacggccccgagcagccatgctgggcgcgcgggcctggttgggccgcgtccttctgctgccccgcgccggtgcaggcctcgccgcgagccgcaggtacgggcgggcgagcgggcccctagggcactccctgcgcctgcctgcgggcccagtggagggtcttccggacaccggtccccacaccagtcctcgccaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaagctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggt

SEQ ID NO: 185637 - DNA, 2669 bp, Homo sapiens
  Payload ID: 16558
  Gene Symbol: SPATA20
  Gene Name: spermatogenesis associated 20
  ENST ID: ENST00000511937
  CDS Start-End: 87-1652
attgtgacccgccctgacctcacagccatccttcccaccgccaggcccaggaggttgggggagactaacctggcaaggagcccccaatgagccacctctcctcaccccccaaaaaacataagggggagcacaaaggccacagtctcccccatggttcagaaaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggtggggcagcacacctgagaccgagcctgtctgcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaagctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 185638 - DNA, 2587 bp, Homo sapiens
  Payload ID: 16558
  Gene Symbol: SPATA20
  Gene Name: spermatogenesis associated 20
  ENST ID: ENST00000634597
  CDS Start-End: 37-2397
gaggttgggggagactaacctggcaaggagcccccaatgagccacctctcctcaccccccaaaaaacataagggggagcacaaaggccacagtctcccccatggttcagaaaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaagctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 185639 - DNA, 2015 bp, Homo sapiens
  Payload ID: 16559
  Gene Symbol: SPATA21
  Gene Name: spermatogenesis associated 21
  Uniprot ID: Q7Z572
  ENST ID: ENST00000335496
  CDS Start-End: 484-1893
actgaaccagtgacaagctgggggaaatgacactgtccagtagttggaggtcacacagccccttgccttattctcaaaccctaaccacatggctggatattcctgaaatgcattcctaaacctctgctgctgagaataattggacctgccatctattcccagtttaactgccctgtataccaaacaaatccaattcaagccaacaggcaaagtataggctcagacagagcccatcctatgtgcaaggcggtgagcaggggtggaaaatctcactgtgactcatccagctgatttctgggctgaacccagacttcacagggctgttaggagaatactgtttacaaaggtttccagcacatggaaggttcctccgtggatgctggcgggcctgccatgatttaaagtggaagaagcaccatcaagatcttcaaggagcacactaggtgatgcccctcacttggcacccgtgttggcgctggcatcatggacaatagaaacacccagatgtacacggaggaggaaaagacagtcaaccccttcctgccatccacgcctggacctaaaaaagcaaaaggagggggtgaggctgtggagacccacccagcaccggggcctcttcctccaccagaggtgagggacattggagagaggcgggagccagaccgtgcgcagcagcagcctcagaagcccgcggtggctgcagggacacagagcctcgggaacttccggcagggcttcatgaagtgcttgctggaggtggagaaaatggaggcctcccatcggagagcctcgaaggcccggtcccagacagcccagaagtcgcccaggaccctgaccccggtgcccacctcagctccaagcctgcctcagacccctgcctcggtccctgccagcggcccatcgtgggcccggctgccagctcctgggccagaacctgcccccatgggagccccggtccccacctccatgccttgccctgtcctgctgggccctgccctggacctgggctggagaaggatggaactcttgcaccagagcagcgagagaaccctgagctacgccaaggcgcggcaggagccggaagagcagagcctccaaaagctttatcaaaaccgggagaagtccgaggagcaactgaccctgaagcaagaggaagccttccgcagctactttgagatcttcaatggtcctggtgaggtggatgcacagagcctgaagaatatcctgctcctaatgggcttctctgtgacgctggcccaggtggaggacgccctgatgagtgctgatgtcaatggagatggtcgtgtggacttcaaagacttcttggctgtgatgacagacaccaggcgcttcttctgctctgtggaacagaacgccctgtcggacatggctccccacaacccccacactctactctttgagatcctgtccctgctggtagagatgctggccttaccagaggcagtcttagaggaaatcacaaactactaccagaaaaagctgaaggaaggcacctgcaaggcccaggagatggaagcggccgtaggccggctgcggttgcagaagcttccctacaacccccagcaagaagagagctcagaagttccagaacgaaaggtcctcagtatcctgagccggctgaagcagcagaactatgctcccaacctgcagagcccctatgcccaggtgccctgcatcctgctctgcccacagctggacaagaagatggtccgtaggcagccgagcaaccactatgcactagaccagtgcacaccccctggcctggatcctgacatccgcagccccttcttccagtcaggatctcaaggaaacagggaacacaactctgacagcagaaagtggctcagctctgtgccagctcgaacccactgaccctctggaggcctgactctaggcagctgctcaaggcctgtagacagatgggccaccaggcaggagctgctgctgggatttgcttttgtggcctggtgagctaataaacaccaataacttca

SEQ ID NO: 185640 - DNA, 1136 bp, Homo sapiens
  Payload ID: 16559
  Gene Symbol: SPATA21
  Gene Name: spermatogenesis associated 21
  ENST ID: ENST00000375577
  CDS Start-End: 341-943
agtgacaagctgggggaaatgacactgtccagtagttggaggtcacacagccccttgccttattctcaaaccctaaccacatggctggatattcctgaaatgcattcctaaacctctgctgctgagaataattggacctgccatctattcccagtttaactgccctgtataccaaacaaatccaattcaagccaacaggcaaagtataggctcagacagagcccatcctatgtgcaaggcggtgagcaggggtggaaaatctcactgtgactcatccagctgatttctggagcacactaggtgatgcccctcacttggcacccgtgttggcgctggcatcatggacaatagaaacacccagatgtacacggagggtagaaccaaggctccagggacgcagccaagtcctggcctgaggatcaccataaagagggctggtgttgagcccatcataccaggagtcagcaaggtcatgtttccggatgcttcggaagtgggcagcaagaagcacctctcatcagcttcacgagggccagagaaggggcccagactcagagatgcatttgagaaggggccttcagagctcagaatccaggagcaggggcctccagcaagaccagggaagaaacagccctcttgggtcccccaggaagggtcccaggagctgcaagcaggccaggatcagagtgagctggggttgctgccttcctgggttcctgaagtacctgaagggctgcagcagctgggctccggaaaggagatcaagggccagcaggggaggcaacggaaccggggaatcggggaggatcagcctcctgagagctgccaggccgggcatggtggctcacgcctgttaatcccagcacttctggaggccgaaggaggcagatcacctgaggtcaagaccagcctggccaacatggtaaaaccctgtctctactaaaaaatataaaattagccgggtgtggtggcacatgcctgtaatcccagctactcaagaggccgaggcaggagaattgcttgaacacgggaggtggaggttgcagtgagctgagatcgcgccattgcactccaaccagggcaatgagagcaaaactccgtctcaaaaaaataaaaataaaataaaaataagtctt

SEQ ID NO: 185641 - DNA, 661 bp, Homo sapiens
  Payload ID: 16559
  Gene Symbol: SPATA21
  Gene Name: spermatogenesis associated 21
  ENST ID: ENST00000491418
  CDS Start-End: 1-483
tctgtggaacagaacgccctgtcggacatggctccccacaacccccacactctactctttgagatcctgtccctgctggtagagatgctggccttaccagaggcagtcttagaggaaatcacaaactactaccagaaaaagctgaaggaaggcacctgcaaggcccaggagatggaagcggccgtaggccggctgcggttgcagaagcttccctacaacccccagcaagaagagagctcagaagttccagaacgaaaggtcctcagtatcctgagccggctgaagcagcagaactatgctcccaacctgcagagcccctatgcccaggtgccctgcatcctgctctgcccacagctggacaagaagatggtccgtaggcagccgagcaaccactatgcactagaccagtgcacaccccctggcctggatcctgacatccgcagccccttcttccagtcaggatctcaaggaaacagggtttaaggaagatggaccatctgcccagttccagcacaaggagcctgggtggaagaaaagcgcttcaagaggacatcgtaggccatgtctgagtaaatgcgcctctgtccccaaactagaacatgattaacatacttggcatgtaatataatactaatagcttttaaaataataccttatatcg

SEQ ID NO: 185642 - DNA, 1773 bp, Homo sapiens
  Payload ID: 16559
  Gene Symbol: SPATA21
  Gene Name: spermatogenesis associated 21
  Uniprot ID: Q7Z572
  ENST ID: ENST00000540400
  CDS Start-End: 335-1675
cctatgtgcaaggcggtgagcaggggtggaaaatctcactgtgactcatccagctgatttctggaagaaacagccctcttgggtcccccaggaagggtcccaggagctgcaagcaggccaggatcagagtgagctggggttgctgccttcctgggttcctgaagtacctgaagggctgcagcagctgggctccggaaaggagatcaagggccagcaggggaggcaacggaaccggggaatcggggaggatcagcctcctgagagctgccaggagggcagacaacaggcatgaacaaagccaagtggtgggaccaggagtaactcactcaagaccatggctcagccgggcgcggtggaacacgcttgtcatcccagcactttgggaggccaaggcggaggatcacttgaggaggtgagggacattggagagaggcgggagccagaccgtgcgcagcagcagcctcagaagcccgcggtggctgcagggacacagagcctcgggaacttccggcagggcttcatgaagtgcttgctggaggtggagaaaatggaggcctcccatcggagagcctcgaaggcccggtcccagacagcccagaagtcgcccaggaccctgaccccggtgcccacctcagctccaagcctgcctcagacccctgcctcggtccctgccagcggcccatcgtgggcccggctgccagctcctgggccagaacctgcccccatgggagccccggtccccacctccatgccttgccctgtcctgctgggccctgccctggacctgggctggagaaggatggaactcttgcaccagagcagcgagagaaccctgagctacgccaaggcgcggcaggagccggaagagcagagcctccaaaagctttatcaaaaccgggagaagtccgaggagcaactgaccctgaagcaagaggaagccttccgcagctactttgagatcttcaatggtcctggtgaggtggatgcacagagcctgaagaatatcctgctcctaatgggcttctctgtgacgctggcccaggtggaggacgccctgatgagtgctgatgtcaatggagatggtcgtgtggacttcaaagacttcttggctgtgatgacagacaccaggcgcttcttctgctctgtggaacagaacgccctgtcggacatggctccccacaacccccacactctactctttgagatcctgtccctgctggtagagatgctggccttaccagaggcagtcttagaggaaatcacaaactactaccagaaaaagctgaaggaaggcacctgcaaggcccaggagatggaagcggccgtaggccggctgcggttgcagaagcttccctacaacccccagcaagaagagagctcagaagttccagaacgaaaggtcctcagtatcctgagccggctgaagcagcagaactatgctcccaacctgcagagcccctatgcccaggtgccctgcatcctgctctgcccacagctggacaagaagatggtccgtaggcagccgagcaaccactatgcactagaccagtgcacaccccctggcctggatcctgacatccgcagccccttcttccagtcaggatctcaaggaaacagggaacacaactctgacagcagaaagtggctcagctctgtgccagctcgaacccactgaccctctggaggcctgactctaggcagctgctcaaggcctgtagacagatgggccaccaggcaggagctgctgctgggatttgcttttgtggcctggtg

SEQ ID NO: 185643 - DNA, 603 bp, Homo sapiens
  Payload ID: 16559
  Gene Symbol: SPATA21
  Gene Name: spermatogenesis associated 21
  ENST ID: ENST00000612240
  CDS Start-End: 1-603
atggacaatagaaacacccagatgtacacggagggtagaaccaaggctccagggacgcagccaagtcctggcctgaggatcaccataaagagggctggtgttgagcccatcataccaggagtcagcaaggtcatgtttccggatgcttcggaagtgggcagcaagaagcacctctcatcagcttcacgagggccagagaaggggcccagactcagagatgcatttgagaaggggccttcagagctcagaatccaggagcaggggcctccagcaagaccagggaagaaacagccctcttgggtcccccaggaagggtcccaggagctgcaagcaggccaggatcagagtgagctggggttgctgccttcctgggttcctgaagtacctgaagggctgcagcagctgggctccggaaaggagatcaagggccagcaggggaggcaacggaaccggggaatcggggaggatcagcctcctgagagctgccaggccgggcatggtggctcacgcctgttaatcccagcacttctggaggccgaaggaggcagatcacctgaggtcaagaccagcctggccaacatggtaaaaccctgtctctactaa

SEQ ID NO: 185644 - DNA, 1280 bp, Homo sapiens
  Payload ID: 16560
  Gene Symbol: SPATA22
  Gene Name: spermatogenesis associated 22
  Uniprot ID: Q8NHS9
  ENST ID: ENST00000268981
  CDS Start-End: 383-1192
gaaactgagggcgaaagttgtgtgtcgtgttggcaggagggcctagaagggaaagactgtgcgttgataccaaactgcccccactccgtgggcgggtcaggagaggcctttggaagagcgtctcaactcggactggagcctcttctctcccaccgcggtcaggagccaaaacaggccgccatttgaggccgtggtttttgtgggtggtgtgtgtgtgtgtgcgtgcagattgagcacactttttgcacaccaatgccaccaaccccattactaacgccacttaggtccatttgggagctgggattgggggtctagtgggacaatgtcatattataaatttggaatgctgaatagaaaattatagattttgatattgaaggaaatgaagcgaagcctaaatgaaaattcagctcgaagtacagcaggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattaggatcgtgaacttccgagactgattagaggccgagttcatagatgtgttggcaactatgaccagaaaaagaacattttccaatgtgtttctgtcaga

SEQ ID NO: 185645 - DNA, 1216 bp, Homo sapiens
  Payload ID: 16560
  Gene Symbol: SPATA22
  Gene Name: spermatogenesis associated 22
  Uniprot ID: Q8NHS9
  ENST ID: ENST00000355380
  CDS Start-End: 126-1088
gcgggaagggcggcggttgctgacggggccgcctggacgacggttgacggaggtctagtgggacaatgtcatattataaatttggaatgctgaatagaaaattatagattttgatattgaaggaaatgaagcgaagcctaaatgaaaattcagctcgaagtacagcagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaa

SEQ ID NO: 185646 - DNA, 1457 bp, Homo sapiens
  Payload ID: 16560
  Gene Symbol: SPATA22
  Gene Name: spermatogenesis associated 22
  Uniprot ID: Q8NHS9
  ENST ID: ENST00000397168
  CDS Start-End: 238-1329
ggcgagggaaactgagggcgaaagttgtgtgtcgtgttggcaggagggcctagaagggaaagactgtgcgttgataccaaactgcccccactccgtgggcgggtcaggagaggcctttggaagagcgtctcaactcggactggagcctcttctctcccaccgcggtctagtgggacaatgtcatattataaatttggaatgctgaatagaaaattatagattttgatattgaaggaaatgaagcgaagcctaaatgaaaattcagctcgaagtacagcaggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaa

SEQ ID NO: 185647 - DNA, 1683 bp, Homo sapiens
  Payload ID: 16560
  Gene Symbol: SPATA22
  Gene Name: spermatogenesis associated 22
  ENST ID: ENST00000541913
  CDS Start-End: 515-1558
gtgcagagaggctttgagggatggtggagtccggctctgctggcctagaagcagagtgcaccctcgtgctcagtgctcagtgggtgtctgaactgaggggcagttgtcaatttgtctgagtgggaaacatcctggattttgttacttggcaaacagctggtgtaaacctacagccagcagcagtctggagcctgggagcctcctgaagtcccgggtgaagcctctggttttaccaattgcaggtcggcttggctgggagagatggatggcgggaaaggggcagcagtcttgaggagcagggagaggagtctttcctcctgccagcttcccccgtcagccccaaccccagcccacacattgtaccatctcttctgctgtgactgggttgcctgaatttgtgggagacccgtgatcccatcccagagtgtgcgggggacggaggtctagtgggacaatgtcatattataaatttggaatgctgaatagaaaattatagattttgatattgaaggaaatgaagcgaagcctaaatgaaaattcagctcgaagtacagcaggctgtttgcctgttccgttgttcaatcagaaaaagaggaacagacagccattaacttctaatccacttaaagatgattcagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattctttt

SEQ ID NO: 185648 - DNA, 577 bp, Homo sapiens
  Payload ID: 16560
  Gene Symbol: SPATA22
  Gene Name: spermatogenesis associated 22
  ENST ID: ENST00000571607
  CDS Start-End: 323-577
gtgtcctatctagattcttccactgacttgctctatagcaatgcacaagctttttgaacttcttttcccttcgagttccctaagtttcaaagtttatattttgtgacttttgacctgaattgagatcctagatccgccatctggaggaatcggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaa

SEQ ID NO: 185649 - DNA, 240 bp, Homo sapiens
  Payload ID: 16560
  Gene Symbol: SPATA22
  Gene Name: spermatogenesis associated 22
  ENST ID: ENST00000570318
  CDS Start-End: 232-240
tgtctgaactgaggggcagttgtcaatttgtctgagtgggaaacatcctggattttgttacttggcaaacagctggtgtaaacctacagccagcagcagtctggagcctgggagcctcctgaagtcccgggtgaagcctctggttttaccaattgcaggtctagtgggacaatgtcatattataaatttggaatgctgaatagaaaattatagattttgatattgaaggaaatgaagcga

SEQ ID NO: 185650 - DNA, 1374 bp, Homo sapiens
  Payload ID: 16560
  Gene Symbol: SPATA22
  Gene Name: spermatogenesis associated 22
  Uniprot ID: Q8NHS9
  ENST ID: ENST00000575375
  CDS Start-End: 155-1246
acagcctgattcccgcgctttcttcgcgggcgggaagggcggcggttgctgacggggccgcctggacgacggttgacggaggtctagtgggacaatgtcatattataaatttggaatgctgaatagaaaattatagattttgatattgaaggaaatgaagcgaagcctaaatgaaaattcagctcgaagtacagcaggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaa

SEQ ID NO: 185651 - DNA, 834 bp, Homo sapiens
  Payload ID: 16560
  Gene Symbol: SPATA22
  Gene Name: spermatogenesis associated 22
  ENST ID: ENST00000571553
  CDS Start-End: 330-834
gcgggcgggaagggcggcggttgctgacggggccgcctggacgacggttgacggaggcgagggaaactgagggcgaaagttgtgtgtcgtgttggcaggagggcctagaagggaaagactgtctagtgggacaatgtcatattataaatttggaatgctgaatagaaaattatagattttgatattgaaggaaatgaagcgaagcctaaatgaaaattcagctcgaagtacagcagaaaaagaggaacagacagccattaacttctaatccacttaaagatgattcagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctt

SEQ ID NO: 185652 - DNA, 1704 bp, Homo sapiens
  Payload ID: 16560
  Gene Symbol: SPATA22
  Gene Name: spermatogenesis associated 22
  Uniprot ID: Q8NHS9
  ENST ID: ENST00000573128
  CDS Start-End: 485-1576
aacaaacggatgtctggaccctaagggccagggggtgaggggaagtggggcacactttttagacgatggtggggctgaggccggttgggcaggagatctgcctctgtctctccagtcacaggacagtctcctttcctctctgggcaaaactctaaggagctggagccatccctgggtccacagtgtgagaacgccaaggaagagcgttaacgtcatcgcgcccggccaagggcggccaggcaggcagcgaagatgccatcgcgccgaggtggcggccactgcgcctgcgcggtccacggcgcctgcgaacagcctgattcccgcgctttcttcgcgggcgggaagggcggcggttgctgacggggccgcctggacgacggttgacggaggcgagggaaactgagggcgaaagtctagtgggacaatgtcatattataaatttggaatgctgaatagaaaattatagattttgatattgaaggaaatgaagcgaagcctaaatgaaaattcagctcgaagtacagcaggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaa

SEQ ID NO: 185653 - DNA, 1399 bp, Homo sapiens
  Payload ID: 16560
  Gene Symbol: SPATA22
  Gene Name: spermatogenesis associated 22
  Uniprot ID: Q8NHS9
  ENST ID: ENST00000572969
  CDS Start-End: 180-1271
cggcggttgctgacggggccgcctggacgacggttgacggaggcgagggaaactgagggcgaaagttgtgtgtcgtgttggcaggagggcctagaagggaaagactgtctagtgggacaatgtcatattataaatttggaatgctgaatagaaaattatagattttgatattgaaggaaatgaagcgaagcctaaatgaaaattcagctcgaagtacagcaggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccctgaaggaaacctcattgtatcagttacagtttaaggaaaaagctagttctttaagaattatttctgcagttattgaaagcatgaagtattggcgtgaacatgcacagaaaactgtacttctttttgaagtattagctgttcttgattcagctgttacacctggcccatattattcgaagacttttcttatgagggatgggaaaaatactctgccttgtgtcttttatgaaatcgatcgtgaacttccgagactgattagaggccgagttcatagatgtgttggcaactatgaccagaaaaagaacattttccaatgtgtttctgtcagaccggcgtctgtttctgaacaaaaaactttccaggcatttgtcaaaattgcagatgttgagatgcagtattatattaatgtgatgaatgaaacttaagtagtgataaaaggaagtttagcataaattatagcagttttctgttattgcttaatttaccatctccatagttttatagctactattgtatttcacttgttgaattaaagtatttgaattcttttaaa

SEQ ID NO: 185654 - DNA, 818 bp, Homo sapiens
  Payload ID: 16560
  Gene Symbol: SPATA22
  Gene Name: spermatogenesis associated 22
  ENST ID: ENST00000574457
  CDS Start-End: 670-818
ctcccgcaagctcccgcagccccggcgctgcctcgctgacggctctccgccttccatggccgccatctgaacctgggcttcagctctgtccccagcctcccggggactcagattccctgaccctgatccgacccagaaattgagccagacacctcgggtggccttcgagtcaatctctgggcacactctgggtggccaccagcatctaacaaacggatgtctggaccctaagggccagggggtgaggggaagtggggcacactttttagacgatggtggggctgaggccggttgggcaggagatctgcctctgtctctccagtcacaggacagtctcctttcctctctgggcaaaactctaaggagctggagccatccctgggtccacagtgtgagaacgccaaggaagagcgttaacgtcatcgcgcccggccaagggcggccaggcaggcagcgaagatgccatcgcgccgaggtggcggccactgcgcctgcgcggtccacggcgcctgcgaacagcctgattcccgcgctttcttcgcgggcgggaagggcggcggttgctgacggggccgcctggacgacggttgacggaggtctagtgggacaatgtcatattataaatttggaatgctgaatagaaaattatagattttgatattgaaggaaatgaagcgaagcctaaatgaaaattcagctcgaagtacagcaggctgtttgcctgttccgttgttcaatcagaaaaagaggaacagacagccattaacttctaatccacttaaagatgattcagattgggcctgggaagctgtgaatcc

SEQ ID NO: 185655 - DNA, 997 bp, Homo sapiens
  Payload ID: 16560
  Gene Symbol: SPATA22
  Gene Name: spermatogenesis associated 22
  ENST ID: ENST00000572582
  CDS Start-End: 506-997
tctccgccttccatggccgccatctgaacctgggcttcagctctgtccccagcctcccggggactcagattccctgaccctgatccgacccagaaattgagccagacacctcgggtggccttcgagtcaatctctgggcacactctgggtggccaccagcatctaacaaacggatgtctggaccctaagggccagggggtgaggggaagtggggcacactttttagacgatggtggggctgaggccggttgggcaggagatctgcctctgtctctccagtcacaggacagtctcctttcctctctgggcaaaactctaaggagctggagccatccctgggtccacagtgtgagaacgccaaggaagagcgttaacgtcatcgcgcccggccaagggcggccaggcaggcagcgaagatgccatcgcgccgaggtctagtgggacaatgtcatattataaatttggaatgctgaatagaaaattatagattttgatattgaaggaaatgaagcgaagcctaaatgaaaattcagctcgaagtacagcaggctgtttgcctgttccgttgttcaatcagaaaaagaggaacagacagccattaacttctaatccacttaaagatgattcaggtatcagtaccccttctgacaattatgattttcctcctctacctacagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcct

SEQ ID NO: 185656 - DNA, 672 bp, Homo sapiens
  Payload ID: 16560
  Gene Symbol: SPATA22
  Gene Name: spermatogenesis associated 22
  ENST ID: ENST00000574051
  CDS Start-End: 45-672
gcctaaatgaaaattcagctcgaagtacagcagtataaagacagatggcaaggatgatgagaaccaggggaatgatgatgcataatgaagataatagctgtttgcctgttccgttgttcaatcagaaaaagaggaacagacagccattaacttctaatccacttaaagatgattcagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaagacaacaccc

SEQ ID NO: 185657 - DNA, 566 bp, Homo sapiens
  Payload ID: 16560
  Gene Symbol: SPATA22
  Gene Name: spermatogenesis associated 22
  ENST ID: ENST00000574797
  CDS Start-End: 121-566
agcctgattcccgcgctttcttcgcgggcgggaagggcggcggttgctgacggggccgcctggacgacggttgacggagattgggcctgggaagctgtgaatccagagttggctcctgtaatgaaaacagtggacaccgggcaaataccacattcagtttctcgtcctctgagaagtcaagattctgtctttaactctattcaatcaaatactggaagaagccagggtggttggagctacagagatggtaacaaaaataccagcttgaaaacttggaataaaaatgattttaagcctcaatgtaaacgaacaaacttagtggcaaatgatggaaaaaattcttgtccagtgagttcgggagctcaacaacaaaaacaattaagaatacctgaacctcctaacttatctcgcaacaaagaaaccgagctactcagacaaacacattcatcaaaaatatctggctgcacaatgagagggctagacaaaaacagtgcactacagacacttaagcccaattttcaacaaaatcaatataagaaacaaatgttggatgatattccagaaga

SEQ ID NO: 185658 - DNA, 909 bp, Homo sapiens
  Payload ID: 16561
  Gene Symbol: SPATA24
  Gene Name: spermatogenesis associated 24
  ENST ID: ENST00000302091
  CDS Start-End: 29-909
atttccaactagctggcgggggcggaagatggcgacgcccctcgggtggtcgaaggcggggtcaggatctgtgtgtctcgctttagatcaactgcgggacgtgattgagtctcaggaggaactaatccaccagctgaggaacgtgatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagaggtagaggtgctatccaagcagctggagaaagagaagctggcctttgaaaaagcgctctccagtgtcaagagcaaagtccttcaggagtccagcaagaaggaccagctcatcaccaagtgcaatgagattgagtctcacattataaagcaagaagatatacttaatggcaaagagaatgagattaaagagttgcagcaagttatcagccagcagaaacagatcttcagcccaccaccagccggctccgttgcaggaatcacatgtctgacttccggatccagaagcagcaggagagctacatggcccaggtgctggaccagaagcataagaaagcctcagggacacgtcaggcccgcagccaccagcatcccagggaaaaataaaatggccgccgctttcctgttctctggctgtaatccccagcctctgccttctctgctctgggagtccccagcctctagcccctgctacttccctccctcttggatagtggtaggggtccacaaggtgggggcttgtagcctaggggaggagctgggtctttgttgtctggtaggcaccaccgcttcctttgggtatttaatcccttcctatataaacagccctggttacccagtaat

SEQ ID NO: 185659 - DNA, 646 bp, Homo sapiens
  Payload ID: 16561
  Gene Symbol: SPATA24
  Gene Name: spermatogenesis associated 24
  Uniprot ID: Q86W54
  ENST ID: ENST00000451821
  CDS Start-End: 8-574
gcggaagatggcgacgcccctcgggtggtcgaaggcggggtcaggatctgtgtgtctcgctttagatcaactgcgggacgtgattgagtctcaggaggaactaatccaccagctgaggaacgtgatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagaggtagaggtgctatccaagcagctggagaaagagaagctggcctttgaaaaagcgctctccagtgtcaagagcaaagtccttcaggagtccagcaagaaggaccagctcatcaccaagtgcaatggtaggcgggaggcccgtgctctccaccacggttatataaacgggctctttcctaaccacccagtgcctgtgtcaaaggcagggtttcactctaacacctgtccccagctgaggatacaggcaggcccgggtgggccacaccttcgaaaaggccttaagggaccaggcaggccacggaaatgagggaagcagtcggtgtactatattcttcaccgccataaaggaatgggcttgctcccatttttcctgaaacat

SEQ ID NO: 185660 - DNA, 659 bp, Homo sapiens
  Payload ID: 16561
  Gene Symbol: SPATA24
  Gene Name: spermatogenesis associated 24
  Uniprot ID: Q86W54
  ENST ID: ENST00000450845
  CDS Start-End: 9-626
ggcggaagatggcgacgcccctcgggtggtcgaaggcggggtcaggatctgtgtgtctcgctttagatcaactgcgggacgtgattgagtctcaggaggaactaatccaccagctgaggaacgtgatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagaggtagaggtgctatccaagcagctggagaaagagaagctggcctttgaaaaagcgctctccagtgtcaagagcaaagtccttcaggagtccagcaagaaggaccagctcatcaccaagtgcaatgagattgagtctcacattataaagcaagaagatatacttaatggcaaagagaatgagattaaagagttgcagcaagttatcagccagcagaaacagatcttcaggaatcacatgtctgacttccggatccagaagcagcaggagagctacatggcccaggtgctggaccagaagcataagaaagcctcagggacacgtcaggcccgcagccaccagcatcccagggaaaaataaaatggccgccgctttcctgttctctggctgtaa

SEQ ID NO: 185661 - DNA, 606 bp, Homo sapiens
  Payload ID: 16561
  Gene Symbol: SPATA24
  Gene Name: spermatogenesis associated 24
  ENST ID: ENST00000507779
  CDS Start-End: 1-558
atggcgacgcccctcgggtggtcgaaggcggggtcaggatctgtgtgtctcgctttagatcaactgcgggacgtgattgagtctcaggaggaactaatccaccagctgaggaacgtgatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagaggtagaggtgctatccaagcagctggagaaagagaagctggcctttgaaaaagctgtcaagagcaaagtccttcaggagtccagcaagaaggaccagctcatcaccaagtgcaatggtaggcgggaggcccgtgctctccaccacggttatataaacgggctctttcctaaccacccagtgcctgtgtcaaaggcagggtttcactctaacacctgtccccagctgaggatacaggcaggcccgggtgggccacaccttcgaaaaggccttaagggaccaggcaggccacggaaatgagggaagcagtcggtgtactatattcttcaccgccataaaggaatgggc

SEQ ID NO: 185662 - DNA, 451 bp, Homo sapiens
  Payload ID: 16561
  Gene Symbol: SPATA24
  Gene Name: spermatogenesis associated 24
  ENST ID: ENST00000514983
  CDS Start-End: 1-451
ccctcgggtggtcgaaggcggggtcaggatctgtgtgtctcgctttagatcaactgcgggacgtgattgagtctcaggaggaactaatccaccagctgaggaacgtgatggttctccaggacgaaaattttgtcagtaaagaagagttccaggcagtggagaagaagctggtggaagagaaagctgcccatgccaaaaccaaggtcctcctggccaaggaagaggagaagttacagtttgccctcggagaggtagaggtgctatccaagcagctggagaaagagaagctggcctttgaaaaagcgctctccagtgtcaagagcaaagtccttcaggagtccagcaagaaggaccagctcatcaccaagtgcaatggaatcacatgtctgacttccggatccagaagcagcaggagagctacatggcccaggtgctggaccagaagcataag

SEQ ID NO: 185663 - DNA, 641 bp, Homo sapiens
  Payload ID: 16561
  Gene Symbol: SPATA24
  Gene Name: spermatogenesis associated 24
  ENST ID: ENST00000509959
  CDS Start-End: 28-528
tttccaactagctggcgggggcggaagatggcgacgcccctcgggtggtcgaaggcggggtcaggatctgtgtgtctcgctttagatcaactgcgggacgtgattgagtctcaggaggaactaatccaccagctgaggaacgtggaagagaaagctgcccatgccaaaaccaaggtcctcctggccaaggaagaggagaagttacagtttgccctcggagaggtagaggtgctatccaagcagctggagaaagagaagctggcctttgaaaaagcgctctccagtgtcaagagcaaagtccttcaggagtccagcaagaaggaccagctcatcaccaagtgcaatggtaggcgggaggcccgtgctctccaccacggttatataaacgggctctttcctaaccacccagtgcctgtgtcaaaggcagggtttcactctaacacctgtccccagctgaggatacaggcaggcccgggtgggccacaccttcgaaaaggccttaagggaccaggcaggccacggaaatgagggaagcagtcggtgtactatattcttcaccgccataaaggaatgggcttgctcccatttttcctgaaacatacaaccttcttagtccaccttttgttttcccacttttgatg

SEQ ID NO: 185664 - DNA, 484 bp, Homo sapiens
  Payload ID: 16561
  Gene Symbol: SPATA24
  Gene Name: spermatogenesis associated 24
  ENST ID: ENST00000512761
  CDS Start-End: 1-462
aaagaagagttccaggcagtggagaagaagctggtggaagagaaagctgcccatgccaaaaccaaggtcctcctggccaaggaagaggagaagttacagtttgccctcggagaggtagaggtgctatccaagcagctggagaaagagaagctggcctttgaaaaagctgtcaagagcaaagtccttcaggagtccagcaagaaggaccagctcatcaccaagtgcaatgagattgagtctcacattataaagcaagaagatatacttaatggcaaagagaatgagattaaagagttgcagcaagttatcagccagcagaaacagatcttcaggaatcacatgtctgacttccggatccagaagcagcaggagagctacatggcccaggtgctggaccagaagcataagaaagcctcagggacacgtcaggcccgcagccaccagcatcccagggaaaaataaaatggccgccgctttcctgttc

SEQ ID NO: 185665 - DNA, 757 bp, Homo sapiens
  Payload ID: 16562
  Gene Symbol: SPATA25
  Gene Name: spermatogenesis associated 25
  Uniprot ID: Q9BR10
  ENST ID: ENST00000372519
  CDS Start-End: 46-729
gcggcagatcactattccctcacaaaccggggctttggggaagccatgtcctacttcaggactccacaaactcatccaggtcctctgccttccggccaaggtggggctgcttctccaggcttgtcccttggcctctgtagtcctgtagagccagtggtggtggcctctggtggaacaggcccactgagccagaaagctgagcaggtggcacctgctgcccaggcctggggcccagccctggcaatgccacaagccaggggctgccctggggggactagctgggagacactacggaaggaatacagccgaaactgccacaaattcccgcatgtgaggcagctggagagcttgggctgggacaatggctactccagaagcagagcccctgacctgggtggccccagcaggcctaggcccctgatgctgtgtgggctgtcaccacgggttctaccggtaccctctgaggcagtggggaaggaggccagctcccagcctgatatctgcatcctcaccctcgccatgatgatcgctggcatccccaccgtgcccgtcccaggagttcgggaagaggacctgatctgggccgctcaagctttcatgatggcccatccggagccagagggtgctgtggagggggcgcggtgggagcaggcacatgcccacacagcctctgggaagatgcccctagtgagatctaaaaggggccagcctcctggctcctgcttgtagatggatgaaatagcaccagatatgtagg

SEQ ID NO: 185666 - DNA, 2335 bp, Homo sapiens
  Payload ID: 16563
  Gene Symbol: SPATA2L
  Gene Name: spermatogenesis associated 2-like
  Uniprot ID: Q8IUW3
  ENST ID: ENST00000289805
  CDS Start-End: 70-1344
ggaagcgcgcggcgcgcggggaggcccgaactgatccgcggcggccggagaccgctggggacagacaggatgggcagcagctcgctgtccgaggactaccgccagtgcctggagcgcgagctgcgacggggccgcgcgggcgtgtgcggggacccctcgctgcgcgcggtgctctggcagatcctggtggaggacttcgacctgcacggggcgctgcaggacgacgcgctggctctgctcaccgacgggctgtggggccgcgccgacctggcgcccgcgctacgcggcctggctcgcgccttcgagcttctggagctcgccgcggtgcacctgtacctgctgccctggaggaaggagttcaccaccatcaagaccttctctgggggctacgtgcacgtgctgaagggtgtgctctcagacgacctcctcctgaagagcttccagaagatgggctacgtacgcagagacagccatcggctcatggtgaccgccctgccccccgcctgccagctggtgcaggtggccctgggctgcttcgccctccggctggagtgtgagatcctgggtgaggtgctggcccagctgggcaccagtgtgctgccagctgaggagctgctgcaggcacggcgtgccagcggggacgtggcctcctgtgtggcctggctgcagcagcggctggcccaggatgaggagccgccacccctgcccccccgaggctcccctgctgcttacagggccccactggacttataccgggacttgcaggaagacgaggggtcggaggacgccagcctgtatggggagccgtcaccaggccctgactcgcccccggcggagctggcctacaggccaccactctgggagcagagtgccaaactgtggggcactgggggccgggcctgggagcccccagctgaggagctgccgcaggccagcagcccaccatatggggccttggaggaggggctggaacctgaaccttccgccttctccttcctctctctgcgccgtgagctgagtaggcctggggacctggccacccctgaaagctctgcagcggccagcccgaggcgtattcgggcagagggggtaccagcctcagcctataggtctgtctcggagcccccaggctaccaggcacacagctgcctgtcccctggcgccctgcccaccctctgctgcgacacctgtcgccagctgcatgctgcccactgtgcagccctgcccgcctgccgtccaggccactcgctgcgtgtgctgcttggcgacgcccagcggcgcttgtggctacagcgtgcacagatggacactctgctctacaacagccccggggcccggccctaggccagctgggccccaggtcaagggctcttgggagacagctcccgtggtgcttctctttgctggggaggggtctgggcctctggttgccttgtccctgggggagtcctgggcacagcagggggttggagagtccaggccaacccttgctggaggtgggactctctgtatatggaaggctccaagggcagcaggcctaagccggccagcaggagcctttccacatttccccaccctcggaacccagacgcatgcccacatgtgctgggtagaggggtccagcctgttccagccagtgcctgaacctgtccctgagaaggaccctgtgccccaaggcccgtggctcctggcctgctccctgcagtacggagtacggggctcaggacttgggggtcctccacgtgtcccagggattctccacacgagtgtcctcaagggcctgttggtgacaccgagctccccccaccccaagctctgctggagccaatctgcggggctctgccgggtgcacggctgacctggcttcggggacgccggccctccccttgggtgtcacagcagctgggcccacagacaggaaatgacctgacctcaaaccagatgtggaggtgcacgagaggcgcaggaacgggcagtggctgacagctgggaaggccctgagcgtcactgctgctgggcggaagggcctgtggacagcccgcccaggcggcggggtcttggtgggtccagtggtaatggtgcccctcccctccattccctgtgggtgcagcccacaggctggcgaggaggtgcctctgccctaccctcgggtctggcgagggagagggcagggtgcatccactgtgacagcccctctgggcccacaactccctgaccctggaagctgagcctgctttcctgaccctccgccccaccccctcctccccagaacactcagagggacggtcaacatcagagcacattaaacgctggtgaaaccatgtctgttaaaaaa

SEQ ID NO: 185667 - DNA, 1001 bp, Homo sapiens
  Payload ID: 16563
  Gene Symbol: SPATA2L
  Gene Name: spermatogenesis associated 2-like
  Uniprot ID: Q8IUW3
  ENST ID: ENST00000335360
  CDS Start-End: 80-538
gactcccggcggaagcgcgcggcgcgcggggaggcccgaactgatccgcggcggccggagaccgctggggacagacaggatgggcagcagctcgctgtccgaggactaccgccagtgcctggagcgcgagctgcgacggggccgcgcgggcgtgtgcggggacccctcgctgcgcgcggtgctctggcagatcctggtggaggacttcgacctgcacggggcgctgcaggacgacgcgctggctctgctcaccgacgggctgtggggccgcgccgacctggcgcccgcgctacgcggcctggctcgcgccttcgagcttctggagctcgccgcggtgcacctgtacctgctgccctggaggaaggagttcaccaccatcaagaccttctctgggggctacgtgcacgtgctgaagggtgtgctctcagacgacctcctcctgaagagcttccagaagatgggctacgtacgcagagacagccatcggctcatgctctgctggagccaatctgcggggctctgccgggtgcacggctgacctggcttcggggacgccggccctccccttgggtgtcacagcagctgggcccacagacaggaaatgacctgacctcaaaccagatgtggaggtgcacgagaggcgcaggaacgggcagtggctgacagctgggaaggccctgagcgtcactgctgctgggcggaagggcctgtggacagcccgcccaggcggcggggtcttggtgggtccagtggtaatggtgcccctcccctccattccctgtgggtgcagcccacaggctggcgaggaggtgcctctgccctaccctcgggtctggcgagggagagggcagggtgcatccactgtgacagcccctctgggcccacaactccctgaccctggaagctgagcctgctttcctgaccctccgccccaccccctcctccccagaacactcagagggacggtcaacatcagagcacattaaacgctggtgaaacca

SEQ ID NO: 185668 - DNA, 692 bp, Homo sapiens
  Payload ID: 16563
  Gene Symbol: SPATA2L
  Gene Name: spermatogenesis associated 2-like
  ENST ID: ENST00000569918
  CDS Start-End: 152-692
tggggacagacaggtagcgccgtcacccgcgggatccgcagctccatctgccgggcgaaggggctctggtcgggagagggctcagcgggcggaagcgcgtctctagagaagggtgcggtcgataaccgggggcgcccctggaaggccgaggatgggcagcagctcgctgtccgaggactaccgccagtgcctggagcgcgagctgcgacggggccgcgcgggcgtgtgcggggacccctcgctgcgcgcggtgctctggcagatcctggtggaggacttcgacctgcacggggcgctgcaggacgacgcgctggctctgctcaccgacgggctgtggggccgcgccgacctggcgcccgcgctacgcggcctggctcgcgccttcgagcttctggagctcgccgcggtgcacctgtacctgctgccctggaggaaggagttcaccaccatcaagaccttctctgggggctacgtgcacgtgctgaagggtgtgctctcagacgacctcctcctgaagagcttccagaagatgggctacgtacgcagagacagccatcggctcatggtgaccgccctgccccccgcctgccagctggtgcaggtggccctgggctgcttcgccctccggctggagtgtgagatcctgggtgaggtgctggcccagctgggcaccagtgtgctgccagctgagg

SEQ ID NO: 185669 - DNA, 766 bp, Homo sapiens
  Payload ID: 16564
  Gene Symbol: SPATA3
  Gene Name: spermatogenesis associated 3
  Uniprot ID: Q8NHX4
  ENST ID: ENST00000455816
  CDS Start-End: 1-579
atgaagaaggtcaagaagaaaaggtcagaggccagacgccaccgagactccacctcccagcatgctagctccaattccacctctcagcagcctagccctgaatccacaccacagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcaggaggtgcttttaatgtgctgataaaccaacctcaggaaggtattatgtacagaagattcccaaggctgctgttgctgaaagagacttgggctactgccagggaactagaaacgtgctgagaagaggactgcaatgactgctttcaaaaa

SEQ ID NO: 185670 - DNA, 1618 bp, Homo sapiens
  Payload ID: 16564
  Gene Symbol: SPATA3
  Gene Name: spermatogenesis associated 3
  Uniprot ID: Q8NHX4
  ENST ID: ENST00000452881
  CDS Start-End: 109-687
gaggcccaagccaggctcctagggcagagggcaaacggcccctccaggagggagccgggagattacgcagctccatgtaggtccacgtttaggttgggaggatctaccatgaagaaggtcaagaagaaaaggtcagaggccagacgccaccgagactccacctcccagcatgctagctccaattccacctctcagcagcctagccctgaatccacaccacagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagacctccaccagccccaggagttgataggtgatggcgctgggagaagatgttcagaatatctcaaaagccaagtccagaaggaggtgcttttaatgtgctgataaaccaacctcaggaaggtattatgtacagaagattcccaaggctgctgttgctgaaagagacttgggctactgccagggaactagggtctcactctgtcacccaggttggagtgcagcaggggcatgatcagctcactgaaggatcatttcttggtctaggctataggctggccttagaatcaactcacctggtgtcctattgtcagggacatcttaaccagggtgactgcacctcgaataaaggccagataaagccaaacttgctgggttacattccttgggggttagacacccttcatcacaagatgtttgtagctcaaagaaggggttaatgatgctaactagagacccagaacgtctgaaaacgtcctgatatttaaagaacaaagcatccttcatttgagaataagtttcactttaaagaccccctcaatatcctcctcagatttgccctgcacttcttgttccatgcttggggtcctaagaacaagccatctgatgcctctactatcattacctctattgggacccagaaaccaataccccaaaatatggtgcatggacatgctgaactgaagaagatgcctcaagggtcatccctaaaggcaaaaacagaacttccaaagtatctttctgtgacaacattaggttcaggcttgaagtccctgatttcgccatcaaagtcagatccaggggggacgatgctattcagaaacgtgctgagaagaggactgcaatgactgctttcaaaaaacaccagaataaatacatacgtagtgtaagcaagcg

SEQ ID NO: 185671 - DNA, 332 bp, Homo sapiens
  Payload ID: 16564
  Gene Symbol: SPATA3
  Gene Name: spermatogenesis associated 3
  ENST ID: ENST00000454918
  CDS Start-End: 65-178
caggagggagccgggagattacgcagctccatgtaggtccacgtttaggttgggaggatctaccatgaagaaggtcaagaagaaaagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctct

SEQ ID NO: 185672 - DNA, 1011 bp, Homo sapiens
  Payload ID: 16564
  Gene Symbol: SPATA3
  Gene Name: spermatogenesis associated 3
  Uniprot ID: Q8NHX4
  ENST ID: ENST00000424440
  CDS Start-End: 114-692
agctggaggcccaagccaggctcctagggcagagggcaaacggcccctccaggagggagccgggagattacgcagctccatgtaggtccacgtttaggttgggaggatctaccatgaagaaggtcaagaagaaaaggtcagaggccagacgccaccgagactccacctcccagcatgctagctccaattccacctctcagcagcctagccctgaatccacaccacagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagacctccaccagccccaggagttgataggtgatggcgctgggagaagatgttcagaatatctcaaaagccaagtccagaagtttgatgtccttccctgtccagagagtgaagaaccatctgacgacagtgacatctttcctttttggggaaagatgcttctagaattttctttcctaaagtttggtgaacctctcccttggcatcttcctcagctgaagatccagtttccatcaaagggacctctcttgtcaccaaaatttaaaaaaagaaaaaaaaaacga

SEQ ID NO: 185673 - DNA, 856 bp, Homo sapiens
  Payload ID: 16564
  Gene Symbol: SPATA3
  Gene Name: spermatogenesis associated 3
  Uniprot ID: Q8NHX4
  ENST ID: ENST00000433428
  CDS Start-End: 97-675
aggctcctagggcagagggcaaacggcccctccaggagggagccgggagattacgcagctccatgtaggtccacgtttaggttgggaggatctaccatgaagaaggtcaagaagaaaaggtcagaggccagacgccaccgagactccacctcccagcatgctagctccaattccacctctcagcagcctagccctgaatccacaccacagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagacctccaccagccccaggagttgataggtgatggcgctgggagaagatgttcagaatatctcaaaagccaagtccagaagatccagtttccatcaaagggacctctcttgtcaccaaaatttaaaaaaagaaaaaaaaaacga

SEQ ID NO: 185674 - DNA, 406 bp, Homo sapiens
  Payload ID: 16564
  Gene Symbol: SPATA3
  Gene Name: spermatogenesis associated 3
  ENST ID: ENST00000440792
  CDS Start-End: 1-315
tccacaccacagcagcctagtcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagatccagtttccatcaaagggacctctcttgtcaccaaaatttaaaaaaagaaaaaaaaaacga

SEQ ID NO: 185675 - DNA, 433 bp, Homo sapiens
  Payload ID: 16564
  Gene Symbol: SPATA3
  Gene Name: spermatogenesis associated 3
  ENST ID: ENST00000423134
  CDS Start-End: 1-262
atccacaccacagcattccagccttgaaaccacctcccggcagccagcattccaagcccttccagcacccgaaatccgccgctcctcttgctgccttttatctccagatgctaacgtgaaggcagcccctcaatccaggaaagcagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagacctccaccagccccaggagttgataggtgatggcgctgggagaagatgttcagaatatctcaaaagccaagtccagaagatccagtttccatcaaagggacctctcttgtcaccaaaatttaaaaaaagaaaaaaaaaacga

SEQ ID NO: 185676 - DNA, 423 bp, Homo sapiens
  Payload ID: 16564
  Gene Symbol: SPATA3
  Gene Name: spermatogenesis associated 3
  ENST ID: ENST00000495639
  CDS Start-End: 1-19
ctgcctactacatcactgaatccttgtgaacaagcccctaggcccacagtctggcagaccccctcaatatcctcctcagatttgccctgcacttcttgttccatgcttggggtcctaagaacaagccatctgatgcctctactatcattacctctattgggacccagaaaccaataccccaaaatatggtgcatggacatgctgaactgaagaagatgcctcaagggtcatccctaaaggcaaaaacagaacttccaaagtatctttctgtgacaacattaggttcaggcttgaagtccctgatttcgccatcaaagtcagatccaggggggacgatgctattcagaaacgtgctgagaagaggactgcaatgactgctttcaaaaaacaccagaataaatacatacgtagtgtaagcaagcg

SEQ ID NO: 185677 - DNA, 786 bp, Homo sapiens
  Payload ID: 16564
  Gene Symbol: SPATA3
  Gene Name: spermatogenesis associated 3
  ENST ID: ENST00000612823
  CDS Start-End: 81-626
gggcaaacggcccctccaggagggagccgggagattacgcagctccatgtaggtccacgtttaggttgggaggatctaccatgaagaaggtcaagaagaaaaggtcagaggccagacgccaccgagactccacctcccagcatgctagctccaattccacctctcagcatcctgaatccacaccacagcagcctagccctgaatccacaccacagcattccagccttgaaaccacctcccggcagccagcattccaagcccttccagcacccgaaatccgccgctcctcttgctgccttttatctccagatgctaacgtgaaggcagcccctcaatccaggaaagcagggcctctgattcgcgccggcccgcattcctgctcctgtgccacttgcccctgcagctccgcttgctggcgtcgtctggggctatgccatagccgcatcttcgatgtccttctgcctcgggactggcagatggcgccagggagaggactccccaacctgctcaccttctacagaaaatcttcaagaaaaccctccagtcatcgtaacgcgtgtcctccaagccctcggaactgtggctgtggctctgggggctctaggagctgcctactacatcactgaatccttgtgaacaagcccctaggcccacagtctggcagacctccaccagccccaggagttgataggtgatggcgctgggagaagatgttcagaatatctcaaaagccaagtccagaagatccagtttccatcaaagggacctctcttgtcaccaaaattt

SEQ ID NO: 185678 - DNA, 1284 bp, Homo sapiens
  Payload ID: 16565
  Gene Symbol: SPATA32
  Gene Name: spermatogenesis associated 32
  Uniprot ID: Q96LK8
  ENST ID: ENST00000331780
  CDS Start-End: 97-1251
agcgcccaccagtccctcagccaaagagcacactggaggcggagaggcagcatccaccagcccgctccccgcctccaggacagagcctcggtctgcatgggggtgacaggtgcccatggatttccatgctgcggcaaagggtcagtggaggttgcagagatgcgagatgacttaagtcaacaccagatacaagaggaacaggagctggaggcagacatgctagagcagaagccccaactccaagtggacctggacctggacccagacccagacccagacccagaactggagatcggacaggtgccggctttactggagtcagagctatacccagccctcaagcttgaagctgagctggacacggaagccaactcgaacgaggagtctgactttgaagaacccatgcagctggtatgcaagatagagtccgtccactccaacatggggctgcccacgccacagaccttcagaccgtggagtctgaattcaaactgccggagtttcacggaggagaaccacgtgtctgcctgccatcactccatcagtgcgcagacctccaagcacctcttctgggcaaacaagctcatccaggcctcagagcacagcctgcagcgggccatcaacatgcagctcaacaatggcagcgcaggccagcccatcagatccccgctccgggaggccatccccaccaacgccctgtgctccgaggagcagctccagatccctgatgcccactcagctcctccaaccacaagctcccaggcaccaagccccctcctgtcctcagatctcccgccacccattgacctgacagagctaatcacctttgcatcttccctggccatggcctcctccagcaggatggacctgcccagtttggaacacatgatgaaagctccaccccaggaggctctggagccttccacagagcccctcctgaccactgtggaggagcgagagccagaaaatcacgcagagaccctgccagagaaaccacgcgaagccagagcaccactgaaatcttggagtcaggaagacaagaacttcgctcaatcttactttgacttcagcaagccggggatcaagagggccaccatcaaagggcaaatccagcttctccagccaccagccacgtcccctctgctgcagggaagcaaggaagactcagtgccgccaggaaaagagaaagagaatccattattggtgaaaatccattttaagctgtcagcccccacaatcccagagaaatgactagacagaaccaataaagcctccagtgctggc

SEQ ID NO: 185679 - DNA, 1907 bp, Homo sapiens
  Payload ID: 16565
  Gene Symbol: SPATA32
  Gene Name: spermatogenesis associated 32
  ENST ID: ENST00000586359
  CDS Start-End: 79-201
agccaaagagcacactggaggcggagaggcagcatccaccagcccgctccccgcctccaggacagagcctcggtctgcatgggggtgacaggcatgagtaggactttgccagaagaaggctttccaggtataagaaatagcatttgcaaaggcactgggtgcagaaaggcctgcggtactctgggggtagcttcggcttagggtgagggacaggaagctggatgccaagagatgaaaaatgaaggtagagatcagaccaagaggccacatggagtctgggggtaaccggagacaagtgagatgtagcaggctcactctgaggtcattgaaaatccaggttggagggggacatagttgcagtggtcccactggaagactaaagagatttaagacagtgcagtgagtagcatcccagagtttggagccagccagacctgcctttgggtcgtgtgctgctcttaatagctgcatgacctcatacacgtttcctcatctgtgagaggagagccgtggccaactgggcataggagtcttgctctgtcacccaggctggagtgcaatggcaccatctcggctcactgcaacgtctgcctcccgggccgaagccatcctccctatcaaaacctaacaaagacattacaagaaaagaaaattatacaccgatatccctcatgaatatgcatgtgaaaattctgaaaaaaagccaatcagattcaacaacatagaaaaagggtgcccatggatttccatgctgcggcaaagggtcagtggaggttgcagagatgcgagatgacttaagtcaacaccagatacaagaggaacaggagctggaggcagacatgctagagcagaagccccaactccaagtggacctggacctggacccagacccagacccagacccagaactggagatcggacaggtgccggctttactggagtcagagctatacccagccctcaagcttgaagctgagctggacacggaagccaactcgaacgaggagtctgactttgaagaacccatgcagctggtatgcaagatagagtccgtccactccaacatggggctgcccacgccacagaccttcagaccgtggagtctgaattcaaactgccggagtttcacggaggagaaccacgtgtctgcctgccatcactccatcagtgcgcagacctccaagcacctcttctgggcaaacaagctcatccaggcctcagagcacagcctgcagcgggccatcaacatgcagctcaacaatggcagcgcaggccagcccatcagatccccgctccgggaggccatccccaccaacgccctgtgctccgaggagcagctccagatccctgatgcccactcagctcctccaaccacaagctcccaggcaccaagccccctcctgtcctcagatctcccgccacccattgacctgacagagctaatcacctttgcatcttccctggccatggcctcctccagcaggatggacctgcccagtttggaacacatgatgaaagctccaccccaggaggctctggagccttccacagagcccctcctgaccactgtggaggagcgagagccagaaaatcacgcagagaccctgccagagaaaccacgcgaagccagagcaccactgaaatcttggagtcaggaagacaagaacttcgctcaatcttactttgacttcagcaagccggggatcaagagggccaccatcaaagggcaaatccagcttctccagccaccagccacgtcccctctgctgcagggaagcaaggaagactcagtgccgccaggaaaagagaaagagaatccattattggtgaaaatccattttaagctgtcagcccccacaatcccagagaaatgactagacagaaccaataaagcctccagtgctggc

SEQ ID NO: 185680 - DNA, 1283 bp, Homo sapiens
  Payload ID: 16565
  Gene Symbol: SPATA32
  Gene Name: spermatogenesis associated 32
  ENST ID: ENST00000588866
  CDS Start-End: 75-188
aaagagcacactggaggcggagaggcagcatccaccagcccgctccccgcctccaggacagagcctcggtctgcatgggggtgacaggtgcccatggatttccatgctgcggcaaagggtcagtggaggttgcagagatgcgagatgacttaagtcaacaccagatacaagaggaacaggagctttgagttgaaacatttcagctggaggcagacatgctagagcagaagccccaactccaagtggacctggacctggacccagacccagacccagacccagaactggagatcggacaggtgccggctttactggagtcagagctatacccagccctcaagcttgaagctgagctggacacggaagccaactcgaacgaggagtctgactttgaagaacccatgcagctggtatgcaagatagagtccgtccactccaacatggggctgcccacgccacagaccttcagaccgtggagtctgaattcaaactgccggagtttcacggaggagaaccacgtgtctgcctgccatcactccatcagtgcgcagacctccaagcacctcttctgggcaaacaagctcatccaggcctcagagcacagcctgcagcgggccatcaacatgcagctcaacaatggcagcgcaggccagcccatcagatccccgctccgggaggccatccccaccaacgccctgtgctccgaggagcagctccagatccctgatgcccactcagctcctccaaccacaagctcccaggcaccaagccccctcctgtcctcagatctcccgccacccattgacctgacagagctaatcacctttgcatcttccctggccatggcctcctccagcaggatggacctgcccagtttggaacacatgatgaaagctccaccccaggaggctctggagccttccacagagcccctcctgaccactgtggaggagcgagagccagaaaatcacgcagagaccctgccagagaaaccacgcgaagccagagcaccactgaaatcttggagtcaggaagacaagaacttcgctcaatcttactttgacttcagcaagccggggatcaagagggccaccatcaaagggcaaatccagcttctccagccaccagccacgtcccctctgctgcagggaagcaaggaagactcagtgccgccaggaaaagagaaagagaatccattattggtgaaaatccattttaagctgtcagcccccacaatcccagagaaatgactagacagaaccaataaagcctccagtgctggc

SEQ ID NO: 185681 - DNA, 2190 bp, Homo sapiens
  Payload ID: 16566
  Gene Symbol: SPATA33
  Gene Name: spermatogenesis associated 33
  Uniprot ID: Q96N06
  ENST ID: ENST00000301031
  CDS Start-End: 1-420
atggtgacgcacgccgctggcgcgaggaccttttgtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaagagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaccccaccctgtgagaaactgcagcccccttctccagtgctttcggggagggtgcaccaggcccgccccaccttgtgagaagccgtggcccccttctccagtgctctcagggagggtgcaccaggcctgcccccgccgtgagaaactgcagtccccttctccagtgctctcggggagggtgcaccaggcccaccccaccctgtgagaacctgcagcccccttctccaatgctctcggggagggtacaccagggttgccccaccctgtgagaagccaccgcccccttctccagtgctctcggggagggtgcaccagggctgccccacgctgtaagaagccgccgcccccttctccagtgctctccagcccgccccaccctgtgagaagccatggccccttctccagtgcttttggggagggtgcaccagggccaccccaccctgtgagaagccgtggcccccttctccagtgctttcggggagggtacaccaggcccgccccaccctgtgagaagccgtggcccccttctcccgtgctctcagggagggtgcaccaggcctgcccccgccttgagaaactgcagcccccttctccagtgctctgggggagggtgcaccaggcctgcccaccctgtgagaaactgcacccccttctccagtgctctcggggagggtgcaccaggcccgccccaccctgtgagaagccgcagcccgttctccattgccatttggtcctgccttccccagagctgctagcagctcggtcgaggcaagagtgactggctcagagagcgagctttgtggtattgataaatgaataaattagtatgttcatgttggaagtggctggctctgcagagtgatggacagcaggtggcatcttacattgtgatttgtggtgcacagttaaaacacttcccttcgtttcagaaggagacaatgtgaatacttggaaattatagtgaataagatgcctcccaaacttgaggaaaaggtcagattctaagagctaaacgttaagatgtaatgttccagaacaaagaggcccagagtcactgaacggggccccagggctcctagcttgagtgtaatctgagtcagcttatgaaaaggccccaaagaagaaagtggaatgtgtgctgggcacatgggacagccatggcactgagactttggaagtggccttgccagcgctgtcctgtctttctggcccacagatgagggctcctgattgtggaaggccacggaagggacctgaacacgatggcacgagacaagttatctcctgtgactgctcctctccagcaaccctcagctcaggctagactttccccctgtgttgagaatgccctgccctgtgtggaagcctgatgcatttagtgacagtgtgttagctttgttagtttctagtctggccagcaggctttccatgtgatctgccattggcttgcttcagtggccagtggagccaggggtgtccaccagagtcttggacacagacttctgaggtggcagcgggagggagcctgctccctgccacacacgtacaatttctaatccatacaggcctatgtagtatatacacacatacgcagagccttaggaattgtgaaaggccaatcaaaacttggggccctaatttcactctgcc

SEQ ID NO: 185682 - DNA, 2368 bp, Homo sapiens
  Payload ID: 16566
  Gene Symbol: SPATA33
  Gene Name: spermatogenesis associated 33
  ENST ID: ENST00000565890
  CDS Start-End: 1-207
accttttgtgagtcgctcccggctccgcggccgcggaggtgtggggacccgggcttgcgtcggagggggcggtgggctcacccatgggcctttccaaaagcaaagagaaacccaggaaaggtaaaggaggcgcaggcgctgggctccccgcgtctccgcccctgggcgcgggcccagggcggggctgggctgggcggggcggtgtgagcgcaggcgccaggctcggcccggtgcgaaccgttcctgccgccgagtccgccacggacggcgcgtttcccgcctgaggcggttacggaaacgcggagactcgagacttgaagccagcttattctggacccacgcaggcgactgaagacgatgggacccactgccctgcattcgagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaccccaccctgtgagaaactgcagcccccttctccagtgctttcggggagggtgcaccaggcccgccccaccttgtgagaagccgtggcccccttctccagtgctctcagggagggtgcaccaggcctgcccccgccgtgagaaactgcagtccccttctccagtgctctcggggagggtgcaccaggcccaccccaccctgtgagaacctgcagcccccttctccaatgctctcggggagggtacaccagggttgccccaccctgtgagaagccaccgcccccttctccagtgctctcggggagggtgcaccagggctgccccacgctgtaagaagccgccgcccccttctccagtgctctccagcccgccccaccctgtgagaagccatggccccttctccagtgcttttggggagggtgcaccagggccaccccaccctgtgagaagccgtggcccccttctccagtgctttcggggagggtacaccaggcccgccccaccctgtgagaagccgtggcccccttctcccgtgctctcagggagggtgcaccaggcctgcccccgccttgagaaactgcagcccccttctccagtgctctgggggagggtgcaccaggcctgcccaccctgtgagaaactgcacccccttctccagtgctctcggggagggtgcaccaggcccgccccaccctgtgagaagccgcagcccgttctccattgccatttggtcctgccttccccagagctgctagcagctcggtcgaggcaagagtgactggctcagagagcgagctttgtggtattgataaatgaataaattagtatgttcatgttggaagtggctggctctgcagagtgatggacagcaggtggcatcttacattgtgatttgtggtgcacagttaaaacacttcccttcgtttcagaaggagacaatgtgaatacttggaaattatagtgaataagatgcctcccaaacttgaggaaaaggtcagattctaagagctaaacgttaagatgtaatgttccagaacaaagaggcccagagtcactgaacggggccccagggctcctagcttgagtgtaatctgagtcagcttatgaaaaggccccaaagaagaaagtggaatgtgtgctgggcacatgggacagccatggcactgagactttggaagtggccttgccagcgctgtcctgtctttctggcccacagatgagggctcctgattgtggaaggccacggaagggacctgaacacgatggcacgagacaagttatctcctgtgactgctcctctccagcaaccctcagctcaggctagactttccccctgtgttgagaatgccctgccctgtgtggaagcctgatgcatttagtgacagtgtgttagctttgttagtttctagtctggccagcaggctttccatgtgatctgccattggcttgcttcagtggccagtggagccaggggtgtccaccagagtcttggacacagacttctgaggtggcagcgggagggagcctgctccctgccacacacgtacaatttctaatccatacaggcctatgtagtatatacacacatacgcagagccttaggaattgtgaaaggccaatcaaaacttggggccctaatttcactctgccaaaag

SEQ ID NO: 185683 - DNA, 470 bp, Homo sapiens
  Payload ID: 16566
  Gene Symbol: SPATA33
  Gene Name: spermatogenesis associated 33
  ENST ID: ENST00000567827
  CDS Start-End: 1-145
gcggaggtgtggggacccgggcttgcgtcggagggggcggtgggctcacccatgggcctttccaaaagcaaagagaaacccaggaaaggtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaaggtaggagacggcgggagggagcgaagcgaggtcagtggcttggaggatctggggctggggtgaggagcctactgtaagaccctaccggatggacactagtagcaggcacgcgccgtaaagatgaaactggtttgttttgggaactttatgtaggagggctcagaacaggcacgcgataaaagccagcaccgttggccgggcgcattgg

SEQ ID NO: 185684 - DNA, 575 bp, Homo sapiens
  Payload ID: 16566
  Gene Symbol: SPATA33
  Gene Name: spermatogenesis associated 33
  ENST ID: ENST00000566204
  CDS Start-End: 1-441
acgccgctggcgcgaggaccttttgtgagtcgctcccggctccgcggccgcggaggtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaagagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaccccaccctgtga

SEQ ID NO: 185685 - DNA, 3339 bp, Homo sapiens
  Payload ID: 16566
  Gene Symbol: SPATA33
  Gene Name: spermatogenesis associated 33
  ENST ID: ENST00000564238
  CDS Start-End: 1-82
ggggacccgggcttgcgtcggagggggcggtgggctcacccatgggcctttccaaaagcaaagagaaacccaggaaaggtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaaggtaggagacggcgggagggagcgaagcgaggtcagtggcttggaggatctggggctggggtgaggagcctactgtaagaccctaccggatggacactagtagcaggcacgcgccgtaaagatgaaactggtttgttttgggaactttatgtaggaggtaaatatccagaaatcttagttgaaaacataagtttaatgaaaatgtaggtcagttcccgagtgataagtgcgtaccaggtggtcgaggggctggggcagtgtgcgtgtgtctcacctgaggttctcctcgagggctgggtatcttggtgccactgagaatccctgagcctccgcacactggaacagagcattgggaggccgtcccaggctggactgtagctctccgagggctgtggggataagtacattgcggagggtgaccgaggagtagaacctgggtgcgacaaaggtgtcttttataacagcctagtgtggccagacctttgggtgtgtgtggggaagatgaggccccaaaagtaggaagaagctagaatacaaagttttccatcagttttaccacgtggagctggaagcgttaaatattttaaacaacggaggtgctgcctggggcggtagttcacacctgtcctcccagttatttggccgaggcaggaggatcttttgagcccaggagttcaagaccagcttgggcaacatagtgagaccctgtctctacaaaaaataaatatttaaaaataaaaaacaagggcggcatgatgaggtctgtgcctaccaacaggggaagccagttcgcaggggaggtggcccggtcagagacccattgctgtggcccagtgggagccagcaaggccttgcagtaggaattgcagaagggtcaggcagggagaacccgcagagcctgccgtccgaggagattgggggcctgtgccaggaggaggtgttttaagtttcatcacaagaatgaaccactcggctgggcgcagtggctcacgcctgtaatcccagcactttgggaggccgaggcgtgtggatcacttaaggtcaggagttcaagaccagcctggccaacgtggtgaaaccctgtctctactaaaaatacaaaaattagctgggcgtggtggcatgtgcctgtaatcccagctactcaggaggctgaggcaggagaattgctcgaaccttgaaccgggacccgggaggcagaagtagtggtgagcgagatcgcaccactgcactccagcctgggctacagagtgagactctgtctcagaaaaaaaaaaaaataataaggagagaaccactcgggtcagacaagaaagaatgtcagggggatgactggcctgctaggcagaggagctgggcctggactgcttcacactgacacgcttgtaggatcaagggctgaaagtaggaggctctgggccttggacttggaagaaagacttggatttgaattcccaactttggaacctcccactggagggtggaacccctcacaggagggcgcaaccccccaccggaggatggaaccctgcaggaatagcatcacccttgggtggcagtttggaaaatgctacctgtctgtcacggtgcttttagctgaaagttacagaaaagctcactaaacgcagctttaacacagggatttaatgtctcacgaatgaagggtcagaggtggagcttccaggttggcttgttagcacaacagtgacatcaaagactttgcgtgtctcttcttgaccactctcagtgtccacagcccccgatgagtgtacagccccccacacgcaggcaggactgcatctactgcaaaggcattgctccttgcttcatattagcaaggaaacctttcccaggaaggcttcgcctgcccagcctctgcaggactcattcaatggtgcaaattcaccaggggctggagggagctgtgaagcatgggagtgggcaggacctctgccagtaacggaagtgggggaaggaggaccgcctgttggaagggccccagcagtgtctgtcacaccagagggtgggggaggaaggtggacatgaagggaaaacagcagagcaagagtgagaacagagtttcagcagataaaatgaagtgtgcacgctctccatgcagtgacgggctgagcgacagtgaggagcaggctgctgactcccttgccacaccgtgaaggagtcccaaaggtgggacactgagtgagacaagccagaggaaagaccactcatgttgcagttccctttccatggaatgtccagaaaaggcacatttacagagagaagcagatgagtggttgctgggcagaaatgggagccggccacagctgagcacaagaggactttggagggtgatggaaatggttttcgacctgaatctgaacatgggaagcactgcagtttagtagtcctggtccctaagcccttccagcccaggagccagacctgtgagcaaacaagcctttagtgattccaggctctggctggaaccttgagtcttctcagcttggggcatgcacctcagggggagccagcatcagtgtccagccccaagagcttccctgtacgtctcagtgagtcttcacatgcctccaactgcctggacaaccacacgtgatacctgtcctgccaaacgtgtcctgaacccataaaatccagagaaaagaaaatcgttttaaactgctgaggtttggggtaagttactatgaagcagtagtgagaagaacagaagggccatgatggggagaaagtttggccataagttaatcactgtggcagctgttaggatattgatgtggcttggctgtgtcctcacccaaatctcattttgaattcccacatgtgggaggaactgggtgggaggtgattgaattatgggggcaggtctttcctgtgctgttttcgtgatagtgaatgagtgtcacgagatccgatggttttaaaaacgggagtttcctgcataagctctctctctgcctgctgccatccatgtaagatgtgactcgctcctccctaccttccgccgtgattgtgaggcgtccccagccatgtggaactgtaagtccattaaaccttcttcctgtgtaaatta

SEQ ID NO: 185686 - DNA, 1264 bp, Homo sapiens
  Payload ID: 16566
  Gene Symbol: SPATA33
  Gene Name: spermatogenesis associated 33
  ENST ID: ENST00000568929
  CDS Start-End: 203-331
ttcccgcctgaggcggttacggaaacgcggagactcgagacttgaagccagcttattctggacccacgcaggcgactgaagacgatgggacccactgccctgcattcggtaagtcccgggtctaacggatgatccatatatttcaggtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaagtgacgggctgagcgacagtgaggagcaggctgctgactcccttgccacaccgtgaaggagtcccaaaggtgggacactgagtgagacaagccagaggaaagaccactcatgttgcagttccctttccatggaatgtccagaaaaggcacatttacagagagaagcagatgagtggttgctgggcagaaatgggagccggccacagctgagcacaagaggactttggagggtgatggaaatggttttcgacctgaatctgaacatgggaagcactgcagtttagtagtcctggtccctaagcccttccagcccaggagccagacctgtgagcaaacaagcctttagtgattccaggctctggctggaaccttgagtcttctcagcttggggcatgcacctcagggggagccagcatcagtgtccagccccaagagcttccctgtacgtctcagtgagtcttcacatgcctccaactgcctggacaaccacacgtgatacctgtcctgccaaacgtgtcctgaacccataaaatccagagaaaagaaaatcgttttaaactgctgaggtttggggtaagttactatgaagcagtagtgagaagaacagaagggccatgatggggagaaagtttggccataagttaatcactgtggcagctgttaggatattgatgtggcttggctgtgtcctcacccaaatctcattttgaattcccacatgtgggaggaactgggtgggaggtgattgaattatgggggcaggtctttcctgtgctgttttcgtgatagtgaatgagtgtcacgagatccgatggttttaaaaacgggagtttcctgcataagctctctctctgcctgctgccatccatgtaagatgtgactcgctcctccctaccttccgccgtgattgtgaggcgtccccagccatgtggaactgtaagtcca

SEQ ID NO: 185687 - DNA, 1297 bp, Homo sapiens
  Payload ID: 16566
  Gene Symbol: SPATA33
  Gene Name: spermatogenesis associated 33
  ENST ID: ENST00000457689
  CDS Start-End: 1-115
gagtcgctcccggctccgcggccgcggaggtgtggggacccgggcttgcgtcggagggggcggtgggctcacccatgggcctttccaaaagcaaagagaaacccaggaaaggtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaagagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaccccaccctgtgagaaactgcagcccccttctccagtgctttcggggagggtgcaccaggcccgccccaccttgtgagaagccgtggcccccttctccagtgctctcagggagggtgcaccaggcctgcccccgccgtgagaaactgcagtccccttctccagtgctctcggggagggtgcaccaggcccaccccaccctgtgagaacctgcagcccccttctccaatgctctcggggagggtacaccagggttgccccaccctgtgagaagccaccgcccccttctccagtgctctcggggagggtgcaccagggctgccccacgctgtaagaagccgccgcccccttctccagtgctctccagcccgccccaccctgtgagaagccatggccccttctccagtgcttttggggagggtgcaccagggccaccccaccctgtgagaagccgtggcccccttctccagtgctttcggggagggtacaccaggcccgccccaccctgtgagaagccgtggcccccttctcccgtgctctcagggagggtgcaccaggcctgcccccgccttgagaaactgcagcccccttctccagtgctctgggggagggtgcaccaggcctgcccaccctgtgagaaactgcacccccttctccagtgctctcggggagggtgcacca

SEQ ID NO: 185688 - DNA, 1490 bp, Homo sapiens
  Payload ID: 16566
  Gene Symbol: SPATA33
  Gene Name: spermatogenesis associated 33
  Uniprot ID: Q96N06
  ENST ID: ENST00000579310
  CDS Start-End: 109-531
ggtgacgcacgccgctggcgcgaggaccttttgtgagtcgctcccggctccgcggccgcggaggtgtggggacccgggcttgcgtcggagggggcggtgggctcacccatgggcctttccaaaagcaaagagaaacccaggaaaggtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaagagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaccccaccctgtgagaaactgcagcccccttctccagtgctttcggggagggtgcaccaggcccgccccaccttgtgagaagccgtggcccccttctccagtgctctcagggagggtgcaccaggcctgcccccgccgtgagaaactgcagtccccttctccagtgctctcggggagggtgcaccaggcccaccccaccctgtgagaacctgcagcccccttctccaatgctctcggggagggtacaccagggttgccccaccctgtgagaagccaccgcccccttctccagtgctctcggggagggtgcaccagggctgccccacgctgtaagaagccgccgcccccttctccagtgctctccagcccgccccaccctgtgagaagccatggccccttctccagtgcttttggggagggtgcaccagggccaccccaccctgtgagaagccgtggcccccttctccagtgctttcggggagggtacaccaggcccgccccaccctgtgagaagccgtggcccccttctcccgtgctctcagggagggtgcaccaggcctgcccccgccttgagaaactgcagcccccttctccagtgctctgggggagggtgcaccaggcctgcccaccctgtgagaaactgcacccccttctccagtgctctcggggagggtgcaccaggcccgccccaccctgtgagaagccgcagcccgttctccattgccatttggtcctgccttccccagagctgctagcagctcggtcgaggcaagagtgactggctcagagagcgagctttgtggtattgataaatgaataaattagtatgttcatgttgg

SEQ ID NO: 185689 - DNA, 1546 bp, Homo sapiens
  Payload ID: 16566
  Gene Symbol: SPATA33
  Gene Name: spermatogenesis associated 33
  ENST ID: ENST00000611218
  CDS Start-End: 258-587
aggctcggcccggtgcgaaccgttcctgccgccgagtccgccacggacggcgcgtttcccgcctgaggcggttacggaaacgcggagactcgagacttgaagccagcttattctggacccacgcaggcgactgaagacgatgggacccactgccctgcattcggtaagtcccgggtctaacggatgatccatatatttcaggtgaggagcaaaagaagggatccacctattcagttccaaaatctaaggagaagttgatggagaagcattcccaggaagccaggcaggcagacagggagtcggagaagcctgtggacagcctccacccgggggccgggacagccaagcacccgccgccggcagcttcgctggaagagaaacctgatgtaaagcaaaagtccagcaggaagaaagtggtcgttccacagatcatcatcacgcgagcgtcgaatgagacgctagtcagttgcagttccagcgggagtgaccagcagagaaccattcgggagccggaggactggggcccctaccggcggcacaggaaccccagtacagcagacgcctataattcacatctcaaagaataaacaagcacctttgcatggcactcgctactccctgcgataggcgtctcgggaacagccgcctcaccctgtgagaagccgaggccccttctccagtgctctcggggaggttgcaccaggcccaccccaccctgtgagaaactgcagcccccttctccagtgctttcggggagggtgcaccaggcccgccccaccttgtgagaagccgtggcccccttctccagtgctctcagggagggtgcaccaggcctgcccccgccgtgagaaactgcagtccccttctccagtgctctcggggagggtgcaccaggcccaccccaccctgtgagaacctgcagcccccttctccaatgctctcggggagggtacaccagggttgccccaccctgtgagaagccaccgcccccttctccagtgctctcggggagggtgcaccagggctgccccacgctgtaagaagccgccgcccccttctccagtgctctccagcccgccccaccctgtgagaagccatggccccttctccagtgcttttggggagggtgcaccagggccaccccaccctgtgagaagccgtggcccccttctccagtgctttcggggagggtacaccaggcccgccccaccctgtgagaagccgtggcccccttctcccgtgctctcagggagggtgcaccaggcctgcccccgccttgagaaactgcagcccccttctccagtgctctgggggagggtgcaccaggcctgcccaccctgtgagaaactgcacccccttctccagtgctctcggggagggtgcaccaggcccgccccaccctgtgagaagccgcagcccgttctccattgccatttggtcctgccttccccagagctgctagcagctcggtcgaggcaagagtgactggctcagagagcgagctttgtggtattgataaatgaataaattagtatgttcatgttgg

SEQ ID NO: 185690 - DNA, 1169 bp, Homo sapiens
  Payload ID: 16567
  Gene Symbol: SPATA4
  Gene Name: spermatogenesis associated 4
  Uniprot ID: Q8NEY3
  ENST ID: ENST00000280191
  CDS Start-End: 110-1027
gcgctgaggtctcgccccataagactccgccccgccccacgagaccgcgccgccagcaataaggcccagccccgccttctgctgttgccgcagcaacccagaaagcgtcatggctgccgccggccaggaaaaagggtatttgacacagactgcggcagccctagacaagtcaccgtcactttcgccacagctagcagctcccatccgagggaggcctaagaagtgtctggtctatccgcatgcgccgaagagctcccgcttgtctcgttccgttctgcgttggcttcagggtctggatctcagcttcttccccaggaacatcaacagagatttttcaaatggcttcctaattgcagaaatattctgtatatattacccctgggaacttgaattatcatcctttgaaaacgggacctctttaaaagtcaagttggataactgggcacagttggagaagttcctggcaagaaaaaaatttaaattacctaaagaactaatccatggaacaattcattgtaaagctggagtgcctgaaatattgatagaagaggtttacactttattaacacatcgagaaattaaaagtatccaggatgactttgtgaatttcacggactatagctaccagatgcgtttacccctggtttccaggtctacagtttcgaagtctattaaagataacattaggttatcagaattactaagcaatcccaacatgctgaccaatgaacttaaagcggagttcctcatccttttacatatgttgcaaagaaaattaggcagaaaattgaatccagaatggtttgatgtgaaaccaacagtgggagaagttactctcaatcaccttcctgcccaagcctctgggcgcagatataatttaaaagttaaaagaggaagagttgtccctgttttaccaaatataggtagtggtggcagttcacatagagaaatacatgtgaagcaagctggacaacattcttattactctgctatgaaacctatcagaaacatggacaagaaaccttgaaaagcacctgtcaaatggctttgaagaagtgatgccaccatctctagccataataaagaaacagaatcacctagtattggatgtatttcaataataaatagagtggtgtcttttccataattgtgttaaagaacatttcttt

SEQ ID NO: 185691 - DNA, 2115 bp, Homo sapiens
  Payload ID: 16567
  Gene Symbol: SPATA4
  Gene Name: spermatogenesis associated 4
  ENST ID: ENST00000515234
  CDS Start-End: 1597-1995
ctgtaatcccagctactggggaggctgcaggcaggagaatgcttgaacccgggaggcggaggttgctgtgagtcgagattatgccgctgcactccagcctaggtggcagggtaagactctgtctcaaaaaaaaaaaaaaaaaaaaaaaaaaaaaatactggtaaggatcagtttaccctttgtcggagatggcatctagtttgagagttaccaacaagtttttaaagttgctgcttaattgtaggcactttgtatgtaactggcagctaatatttgctctgggaatgcaaactaaattctataaaaaggcaatgaatcttttgcagaactctggtttaaagtagtctctccttatcagagaggcataggttccaagatccccagtggatggcaactgtggatactacagaaccctctgtcagaacacatttctgtttatgtcttccatccacaaatttaatgcctttttaaaaatcttaactaagcacttatcacacactgtggctgaaagtttttcagtttgaggtgtgatgccgaaactatcaagaatttctttttcttcatatttcaggaatatgattcattcctaccattgtaaccattcttacaactttctattaagtcaagaactttcatcttttcacctaaaggaataattttatggtttctctctggcatatctgaatcaccagcatcactgctcttgcactttgcacacaagcgcaccacactgtacagttgatctgatgactaaaaggtgactgatgtctacaacgtggagactctggacaaagggaggactcacatcctaggcaacacagagcaggcagggaggtttcatcagactgcccagaacagagtacaatttaaaagttacaaattatttcttgaattttccatttaatattttccgactgtgattgacccaaggtaactgaaactgcagaaagcaaaactgcagataagcgggggactagtttactaatttgtcttcagtattacttacaaccatgcctctgaaattttaaagtgcatatgaatcacctggggatcttcttgaaatgcggattcaatacaaattaacagtttgggttcatcaaaagaacaccaaagcctttgaaacgtagataatcttagcaaaattccacagtaggttctccttagagcaacgatccaacaacactcactttacaagatacttttagtatggaatattagactagtattaattataaaataatacaaactgcataattaactacactttatttcatttcctaattgccacggatcagagatttttcaaatggcttcctaattgcagaaatattctgtatatattacccctgggaacttgaattatcatcctttgaaaacgggacctctttaaaagtcaagttggataactgggcacagttggagaagttcctggcaagaaaaaaatttaaattacctaaagaactaatccatggaacaattcattgtaaagctggagtgcctgaaatattgatagaagaggtttacactttattaacacatcgagaaattaaaagtatccaggatgactttgtgaatttcacggactatagctaccagatgcgtttacccctggtttccaggtctacagtttcgaagtctattaaagataacattaggttatcagaattactaagcaatcccaacatgctgaccaatgaacttaaagcggagttcctcatccttttacatatgttgcaaagaaaattaggcagaaaattgaatccagaatggtttgatgtgaaaccaacagtgggagaagttactctcaatcaccttcctgcccaagcctctgggcgcagatataatttaaaagttaaaagaggaagagttgtccctgttttaccaaatataggtagtggtggcagttcacatagagaaatacatgtgaagcaagctggacaacattcttattactctgctatgaaacctatcagaaacatggacaagaaaccttgaaaagcacctgtcaaatggctttgaagaagtgatgccaccatctctagccataataaagaaacagaatcacctagtattggatgtatttcaataataaatagagtggtgtcttttccataa

SEQ ID NO: 185692 - DNA, 403 bp, Homo sapiens
  Payload ID: 16567
  Gene Symbol: SPATA4
  Gene Name: spermatogenesis associated 4
  ENST ID: ENST00000508699
  CDS Start-End: 1-231
aaagggtatttgacacagactgcggcagccctagacaagtcaccgtcactttcgccacagctagcagctcccatccgagggaggcctaagaagtgtctggtctatccgcatgcgccgaagagctcccgcttgtctcgttccgttctgcgttggcttcagggtctggatctcagcttcttccccaggaacatcaacagaaatattctgtatatattacccctgggaacttgaattatcatcctttgaaaacgggacctctttaaaagtcaagttggataactgggcacagttggagaagttcctggcaagaaaaaaatttaaattacctaaagaactaatccatggaacaattcattgtaaagctggagtgcctgaaatattgatagaagaggtttacacttta

SEQ ID NO: 185693 - DNA, 506 bp, Homo sapiens
  Payload ID: 16568
  Gene Symbol: SPATA45
  Gene Name: spermatogenesis associated 45
  Uniprot ID: Q537H7
  ENST ID: ENST00000332912
  CDS Start-End: 109-405
tcccagtgggctaatccacaccagtggacttgaaacacgctttgggttgctgtatggtagtatgctaaaggacagcaagaatcacttgacaattggtttgtgaccataatggcatctataaacagaaccattgaaataatgaaaaaacatggagtaagcaaacaacatctcctggaggagataaacaaaaagcgtgaatccaactgcttggtggaacgaagcaatcaagtcagcttactgagagttcaaaagaggcacttcccggatgcctatcagtcctttactgataccacaaccaaagagcctgttcccaacagtggcaggagctcctggatcaagctgagtctccttgctcacatggagagaaagcactttccaccaaaaaataatgccatatttggataaagtgcatctccagagacacacggaaatacattctctttgattcttcttcagtgtgtctaaattatttacaaattattaattataaacaaagctaaacaaaa

SEQ ID NO: 185694 - DNA, 8137 bp, Homo sapiens
  Payload ID: 16569
  Gene Symbol: SPATA5
  Gene Name: spermatogenesis associated 5
  Uniprot ID: Q8NB90
  ENST ID: ENST00000274008
  CDS Start-End: 70-2751
ttttctctcagttgaagcgcgcacattgagtcggcttttctactgcttcggctagggtaccttgtgaccatgtcttccaagaagaatagaaagcggttgaaccaaagcgcggaaaatggttcgtccttgccctctgctgcttcctcttgtgcggaggcacgggctccttctgctggatcagacttcgcggcaacctccgggactctgacggtgaccaacttattagaaaaggtagatgacaaaattcctaaaacattccagaattcccttattcatcttggactcaacactatgaagtctgcaaatatatgtataggtcgaccagtgttgcttactagtttgaacggaaagcaagaggtgtatacagcctggcctatggcaggatttcctggaggcaaggtcggcctgagtgaaatggcacagaaaaatgtgggtgtgaggcctggtgatgccatccaggtccagcctcttgtgggtgctgtgctacaggctgaggaaatggatgtggcactgagtgacaaagatatggaaattaatgaagaagaactgactggttgtatcctgagaaaactagatggcaagattgttttaccaggcaactttctgtattgtacattctatggacgaccgtacaagctgcaagtattgcgagtgaaaggggcagatggcatgatattgggagggcctcagagtgactctgacactgatgcccaaagaatggcctttgaacagtccagcatggaaaccagtagcctggagttatccttacagctaagccagttagatctggaggatacccagatcccaacatcaagaagtactccttataaaccaattgatgacagaattacaaataaagccagtgatgttttgctggatgttacacagagccctggagatggcagtggacttatgctagaggaagtcacaggtcttaaatgtaattttgaatctgccagagaaggaaatgagcaacttactgaagaagagagactgctaaagttcagcataggagcaaagtgcaatactgatactttttattttatttcttcaacaacaagagtcaattttacagagattgataaaaattcaaaagagcaagacaaccaattcaaagtaacttatgacatgataggaggattaagtagccagctgaaagcaattagagaaataattgaattgcccctcaaacagcctgagcttttcaagagttatggaattcctgcccctagaggagtgttactttatggtcctccaggtactggaaaaacaatgatcgccagggctgttgctaatgaagttggagcctatgtttctgtaattaatggtcctgaaattataagcaaattctatggtgagactgaagcaaagttacgtcagatatttgctgaagccactctacgacacccatcaattatttttattgatgagctggatgcactttgtccgaaaagagagggggcccagaatgaagtggaaaaaagagttgtggcttcactcttaacactgatggatggcattggttcagaagtaagtgaaggacaagtgttggttcttggggccacaaatcgccctcatgccttggatgctgctctccgaagacctgggcgatttgataaagagattgagattggagttcccaatgctcaggaccggctagatattctccagaaactgcttcgaagggtaccccatttgctcactgaggctgagctgctgcagctggcaaatagtgctcatggatacgttggagcagacttgaaagtcttgtgtaatgaagcaggtctctgtgccttgcggagaatcctgaaaaaacagcctaacctccctgatgtcaaggtggctggactggtgaagattactctgaaggatttcttgcaggcaatgaatgatatcagacccagtgccatgagggaaatagcaattgatgtcccaaatgtatcctggtcagatataggaggactggaaagtatcaaactgaagttggaacaggctgtggaatggcccttaaaacatccagagtctttcattcgaatgggtattcagccacctaaaggagttcttctctatgggccacctgggtgctctaaaacaatgatagcaaaggctttggccaatgagagtggactgaattttctagctataaaggggcctgaattaatgaataaatatgttggtgaatctgaaagagcagttagagagaccttccgaaaagcaagagcagtggcgccttccattattttctttgatgaactggatgccttagcagttgaaaggggcagttctttaggtgctgggaatgtagccgatcgtgttttggctcagctcttaacagaaatggatgggattgaacagctaaaggatgtgaccattttggcagctactaaccgtccagataggatagacaaggctttgatgcggcctggaagaattgatagaatcatctatgtgcctttaccggatgcagcaacaagaagggaaatatttaagctgcagtttcactccatgcctgtcagtaatgaagttgacctggatgaactcatccttcaaaccgacgcatactcaggagcagagattgtagctgtctgcagagaggcagctcttctggctctggaagaagacattcaagccaatctcatcatgaaaagacatttcactcaggccttgagcactgtgacacctagaattcctgagtcattgagacgtttttatgaagattatcaagagaagagtgggctgcatacactctgagaaaatatatatattcaagatgctgaaaatcctttccagagaaaatttgtttctttttaaaattttttgagagtgttaaaaaaaattttactaggcaaaatgtttgaagtatgttcagtagaatttaggggctttggttcttacagattttcaagtcatgtaagtacagtgaaaatatctctgagcataagtttcaatcagttttacctggaaatttgtggtgtggtttaaaaaacaaatgtttagctttttcatttgcgacctagtctgttcatcccatgaagcgatttctttttccagaatctgtttgagtgtctttctaaaatgccaaacatgttggcatcaattttatacagggatataaaaaagtatatgtggataaattttttgtaatctttagggatataaaaaagtgtatgtggataaattttttgtaatctttatttttgaaggccagccagtaaaatggcccaatgtgccagccaggcttatgtggccttgttttcaaatatacatatatgtgttatcattaaaattcatatatgcatttttgttttagccttcttaatctctacctatggccaaaaaaattttttttgagagatattttgtataatacaatgccctttgaaagtgtaagcccactctaagcctagatcagtaggcttgggttttttttgttgttgttttgtcttttttttttttttttgagacagagtctcactctgtcacctaagctggagtgcagtggcacgatcttggctcactgcaacctccgcctcctgagttcaagcaattctcctgcctcaacctcctgagtagctgggactacaggtgtgcaccaccacacgcagctaatttttatatttttagtagagacaaggtttcaccatgttagccaggccggtctcgaactgctggcctcaggtgacccacccacctgagcctcccaaagtgctgggattacaggcgtgagccaccatacctggagaggttttgtgtttttgtttttttttcataaaatgcttttaataaatcatatgaagcattcatgtttttacttatacatattttcagggtaccagtaaactttttagttcaaagataggccaaattgtacttttttttttttatgagacagagtctcgctgctctgtcgcccaggctagagtgcagtggcgtgatctaggctcactgcaagctctgcctcctgggtttacttacgccattctcccgcctcagcctcctgagtagctgggactacaggtgcccaccaccatgcctggctaatttttttttttttttttttttattagagacagggtttcaccgtgttagccaggatgatctcgatctcctgacctcgtgatccgcccgcctcggcctcccaaagtgctgggattacaggcatgagctactgcgccctgccgccaaattgtaatcttaaacatattatgttgcattctaaatatgtatatttatgcttcttgttatttatcctcaggatttcttcacactttattacttcataaatactcttgaaaaagctttcagaaagtgattctctgacttcagatcagaaactggcaatgggaagaatgtgcacttaaacttgatcactgtagatctttgaaaattcccagaaagacaaatcagacaagaaatacctgattatcaaaataatgggctatacagttttgtggtggcatacattccttgtttgtttgtttagagataggatcttgttgtgtcacccaggctggaatgcagtggcacagtcgtagctcactgcaccttcaaactcctggagctcaagtgatcctcctgactcagcctcctgagtagctaggacaacaggtgcacactgccatgtcaggctaatttttttttttaaacagagagacagagtcttgctgtgttgcccaggctggtctccaactcctggcctcaggtgaccctcctgcctcagcttcccaaagggctgagattacaggtgtgagccaccatgcccagcctgtggtgacatatattctgaagtcacatctcaaatatttaatcctcaaatatatttacatcctcaaaaatatcagattttcaagacaacactggtttaccagtacataaacccacctaggggacaaagaatattaccacttagaactgtgttgtcaaatacaataaccactaattgtatctgaccattttaattaaattaattacaattaaataatatttaagaattagtttatcagacatatcagccacatttcaaatgctcaatagctacatgtggcaagggtctgccacactggacagagtagaaaacattcccatcattcagaaggttctcttggacgctgcagatctggaaaacaagacttccatattgaaataaatacaacctcaaaacttttatgctctgtgttccctttagttgttatctacatagaaaattatgaaacaagagaggaacttaccttcttccctattaaatatatggctaagggcacaagaaaataagaggaaaacttatccttcagggcctaaacaaggaaatgaaagaaatctcattcccaatagaataaaaaccagaagcttgaaatgactctggtgcaggaggctgggtggtggggaggagggtagcagtctcaatcaacaagtttagatattaatagccactcaaagccttcagcccatataacatgaagtgacaactgagctctgcacataatgctcaagctctataataaccaacactctcagcacaagggtagacaagaaaagaaaaatctcctgctggccaggaagaccacaaggaggctttctgacttggcctgtgcttttgatttttaaaacattttttaaaagaggcctctctgggctgggcgcggtggctcatgcctgtaatcccagcactttgggaggccgaggcaggcggatcacgaggtcagaagatcaagaccatcctggctaacacagtgaaaccccgtctctactaaaaattcaaaaaattagccgggaatggtggtgggcgcctgtagtcccagttactcgggaggctgaggcaggagaatggcgtaaacccgggagacggagcttgcagtgagctgagattgcgccactgcactccagcctgggtgacagagtgagactccgtctcaaaaaaaaaaaaaaaaaaacctctgagaattctgactatgagcttacctgcccatggctttagaatgatttgaattcacactaccttcaaattcatgaaacctcaaaacctacaaattaacctaaaaacatggagccaagctaaaaatgccctgggggtaactagcacttggactagttacaggaatgtagcttcgtctcagaggattccaaaagctaatgccttgcttaccaagggcttgtaatctcacaggatgtgatgggtggggcctcagatctgctgatgggagcataaattggtacaaccactttggaaggcaactggctatctagcaaagttgaagaccctacaatctaacagttctcctaggtgcatatcccagagcaagtctcacattgatgcagtgagatagtgaataggaaagttcatagcaccattatttttaagtagtaagaacccggaaacaatctaaatatccatcagtaatagatatatgtgatagtcatacaatggaatactgtggcaataaaaaataattagagctacatatgaaatagggatgaaacatggatgaacaaagaatgttttagaggaatatgatatttaaaatttgaagcatgaaaaatatgtgtttatgggggcatatatagtggaagaataaatgaatagaaaagaaaagcaccaaatactggtgaggaatttcctcaggggagaaaagttgagctgcttcaattgtgtcagtaatgtttcatatcttagggtgggtgatgggaatataggtgctgatttaatatagtctgtactttttgtgtacctaaatatttcgtgataatttttaaaagatgggccttaaaccaatacagtcatatcatttaactcaattccatgaatttacaatgcaatccacagtgcccacaaccccatgtttctggaaaatcaggagtattgggtacaatggaataaaatgcaagaaggcaaataagagatcaggcttttaggacctaggaaacaaataaagaggaatttgttgctgaaagtaatgtgtagctgacactctcattacctgacacaatgggagacattatgtctgggaataagacatctatttccatagcactgtagtcctgcaaaggagttggaagttatgaatttttaaagattttagaacattatatctttagtctctcataagccaattatttatatctccacatagcccattattaccattgaaaaggcatgcaattcttctatttgaagcttgttccctttttacaaaagtactagtaaaaatctgagtcatacaaaagagcaggtcaggtgtcactaataacagtttacctcagcttcatctccatgaaggttttacttctaatcccagagtctcatgtttatgtattacaagagtgtatgaaagctgggcatggtggcacacaccagtagtcccagctactcggtcgggggttgaggtgagaggatcgcttgaactcaggagtttgaatccagcctggtcaatgtagcgagatcctatctcttaaaaaaaaaaaaaaaaggggggaacagtgtatgatcctattatttgggtttgtgtgtgatcgaatacatggtatatagttcatggaaaatttaagctcagcaaggaaagaaaatggccagcttcctgtcttaggaagacaatttactttttggcatctgtttggttgaaagtttgcctttgatccagattctttcggatgtcagggatattcacattgacatgtctttttagtgttccaggagattttagtttgaatagtacaattttttcttcttacaacaaaacttagaacggcttctaacttatttcttcatggccaagaaactaccctaacttatctcgataaatatttagttctgtcttatttctaatgtgtaaaacaggttttaaaaataatatatagattttgcatttataaaaaaagatttaatttatagaaccaaacttgaacatatgtttaatttagcctaatcagaaggttacagaaaaagttgctgtaaagatagaataaaggtattgtactggtctgtttttactgaagttccagaatgtgaggttattagagtcttggcttattgtgtcatgttttcctgaatgcttcctttgaagatgagcacacaccaaagcatcctttgatattatgtatggattaaattaacactgctttccaaatgtggtccacatagaaa

SEQ ID NO: 185695 - DNA, 2570 bp, Homo sapiens
  Payload ID: 16570
  Gene Symbol: SPATA5L1
  Gene Name: spermatogenesis associated 5-like 1
  Uniprot ID: Q9BVQ7
  ENST ID: ENST00000305560
  CDS Start-End: 100-2361
cgcgcaatctgcttccggcctgcgagctcggtgttccgctttttgtgggccgggtgggtttcctaatctggtttcgtctgcctggttcatctgtgtgcgatggctccggactcggatcccttccctgaagggccgctcttaaagctgctacccttagacgctagagaccggggcacccagcgctgccgcctgggcccggccgccctccacgccctgggcgcgcgcttgggctcggcagtgaagatctcgctacccgacggcggctcctgcctctgcactgcctggcctcggcgggacggagcggacggctttgtgcagctggacccgctgtgcgcgagccccggggcggcggtcggggcgtcgagatcccggaggagtctcagcctgaatcgcctcctcctagtgccctgtccgcccctgcggcgcgtcgccgtgtggccggtgttgcgagagcgggcaggcgcgcccggtgcccggaatacagccgcggtgctggaggcggcacaggagctgctgagaaaccgaccgatctccctgggccacgtggtggtcgctccgccaggcgctcctggcctggtggctgccttgcacatcgtcggcgggacgcccagtcccgatcccgctgggctggtcacccctcgtacccgcgtcagccttggcggggagcctccgtcggaagcccagccgcagcccgaggtgcccctgggaggtctttcggaggcggccgactcgctgcgggagctcctccgcctcccgctccgctacccgcgcgccctgaccgcgctgggcttagcggtgcctcgcggggtgctcctggcggggccccccggagtgggcaagacccagctggtgcgggccgtggcgcgcgaggcgggcgcggagctgctggcagtcagcgccccggcgctgcagggttcccggcctggggagaccgaggagaacgtgcggcgggtcttccagcgcgcccgggaactggccagccgcggacccagcctcctcttcctggacgagatggacgccttgtgtccccagcggggcagtcgagcacccgagagccgcgtagtggcccaggtgttgacgctgctggacggcgccagtggggaccgcgaggtcgtggttgtgggagccactaaccggccggacgctctagacccagcgctgcgtaggcccgggagatttgaccgagaggtggtcattgggactcccacacttaaacaaagaaaggaaattctgcaagtgattacctcgaagatgcccatctccagtcatgttgatttgggccttcttgcagaaatgacagttggctatgttggtgccgacctgacagcactctgtagggaggctgccatgcatgccctccttcatagtgagaagaaccaggacaatcctgtgattgatgaaatagacttccttgaagcttttaaaaatattcagccctcatcgtttcgaagcgtcattggattaatggatatcaagcctgttgactgggaggagattggtggccttgaagatgtaaaactgaagttaaaacagagcattgagtggcctctgaaattcccttgggaatttgttagaatgggcctgacacaaccaaagggagttctcctctatgggccccctggatgtgctaaaaccactctggtgagggccctggccacaagctgtcactgctctttcgtttcagtgagtggagctgatctgttttcaccgtttgttggagattcagaaaaagtgttgtctcagatatttcgacaagcaagagcaagcactccagcaattttgtttttggatgaaattgattcaatcttgggagctcgctcagccagcaagacaggatgtgatgttcaagaacgagttctttctgttctcctgaatgaattagatggtgttggacttaagacaatagagagaagaggaagtaaatcaagtcaacaggagtttcaagaagtttttaaccgaagtgtcatgattattgcagcaacaaatagacctgatgtgttagatactgctttgttacgacctggaagattagataagatcatctatatcccacctccagatcacaagggcaggctttctattttaaaagtctgtacaaaaaccatgccaatagggcctgatgtctccttagaaaacctcgcagcagaaacctgttttttttctggagctgatcttagaaacctctgcacagaagctgctttgctggctctgcaagaaaatggactagacgcaactacagtgaaacaagagcactttctaaaatcacttaagactgtaaaaccgtcgttaagttgcaaggacttggctttatatgaaaacttatttaagaaagaaggattttctaacgtggaaggtatttaaaaatcaccttaaactcttgttcagttcacattaattgaaatgtgaacttgcctgtcgtttgcaacttcacacttttagaatttgtgtttatatttcctgtaagtgaataaataaaacaaaacaaaacaaaaaaaacttgtgcctgataagctaaggctcatttatttttaaaaggcatattaaataaaatactgtaatttaggaagaaa

SEQ ID NO: 185696 - DNA, 944 bp, Homo sapiens
  Payload ID: 16570
  Gene Symbol: SPATA5L1
  Gene Name: spermatogenesis associated 5-like 1
  ENST ID: ENST00000531624
  CDS Start-End: 1-776
accaggacaatcctgtgattgatgaaatagacttccttgaagcttttaaaaatattcagccctcatcgtttcgaagcgtcattggattaatggatatcaagcctgttgactgggaggagattggtggccttgaagatgtaaaactgaagttaaaacagatatttcgacaagcaagagcaagcactccagcaattttgtttttggatgaaattgattcaatcttgggagctcgctcagccagcaagacaggatgtgatgttcaagaacgagttctttctgttctcctgaatgaattagatggtgttggacttaagacaatagagagaagaggaagtaaatcaagtcaacaggagtttcaagaagtttttaaccgaagtgtcatgattattgcagcaacaaatagacctgatgtgttagatactgctttgttacgacctggaagattagataagatcatctatatcccacctccagatcacaagggcaggctttctattttaaaagtctgtacaaaaaccatgccaatagggcctgatgtctccttagaaaacctcgcagcagaaacctgttttttttctggagctgatcttagaaacctctgcacagaagctgctttgctggctctgcaagaaaatggactagacgcaactacagtgaaacaagagcactttctaaaatcacttaagactgtaaaaccgtcgttaagttgcaaggacttggctttatatgaaaacttatttaagaaagaaggattttctaacgtggaaggtatttaaaaatcaccttaaactcttgttcagttcacattaattgaaatgtgaacttgcctgtcgtttgcaacttcacacttttagaatttgtgtttatatttcctgtaagtgaataaataaaacaaaacaaaacaaaaaaaacttgtgcctgataagctaaggctcatttatttt

SEQ ID NO: 185697 - DNA, 2464 bp, Homo sapiens
  Payload ID: 16570
  Gene Symbol: SPATA5L1
  Gene Name: spermatogenesis associated 5-like 1
  Uniprot ID: Q9BVQ7
  ENST ID: ENST00000531970
  CDS Start-End: 56-1918
gtgggccgggtgggtttcctaatctggtttcgtctgcctggttcatctgtgtgcgatggctccggactcggatcccttccctgaagggccgctcttaaagctgctacccttagacgctagagaccggggcacccagcgctgccgcctgggcccggccgccctccacgccctgggcgcgcgcttgggctcggcagtgaagatctcgctacccgacggcggctcctgcctctgcactgcctggcctcggcgggacggagcggacggctttgtgcagctggacccgctgtgcgcgagccccggggcggcggtcggggcgtcgagatcccggaggagtctcagcctgaatcgcctcctcctagtgccctgtccgcccctgcggcgcgtcgccgtgtggccggtgttgcgagagcgggcaggcgcgcccggtgcccggaatacagccgcggtgctggaggcggcacaggagctgctgagaaaccgaccgatctccctgggccacgtggtggtcgctccgccaggcgctcctggcctggtggctgccttgcacatcgtcggcgggacgcccagtcccgatcccgctgggctggtcacccctcgtacccgcgtcagccttggcggggagcctccgtcggaagcccagccgcagcccgaggtgcccctgggaggtctttcggaggcggccgactcgctgcgggagctcctccgcctcccgctccgctacccgcgcgccctgaccgcgctgggcttagcggtgcctcgcggggtgctcctggcggggccccccggagtgggcaagacccagctggtgcgggccgtggcgcgcgaggcgggcgcggagctgctggcagtcagcgccccggcgctgcagggttcccggcctggggagaccgaggagaacgtgcggcgggtcttccagcgcgcccgggaactggccagccgcggacccagcctcctcttcctggacgagatggacgccttgtgtccccagcggggcagtcgagcacccgagagccgcgtagtggcccaggtgttgacgctgctggacggcgccagtggggaccgcgaggtcgtggttgtgggagccactaaccggccggacgctctagacccagcgctgcgtaggcccgggagatttgaccgagaggtggtcattgggactcccacacttaaacaaagaaaggaaattctgcaagtgattacctcgaagatgcccatctccagtcatgttgatttgggccttcttgcagaaatgacagttggctatgttggtgccgacctgacagcactctgtagggaggctgccatgcatgccctccttcatagtgagaagaaccaggacaatcctgtgattgatgaaatagacttccttgaagcttttaaaaatattcagccctcatcgtttcgaagcgtcattggattaatggatatcaagcctgttgactgggaggagattggtggccttgaagatgtaaaactgaagttaaaacagagcattgagtggcctctgaaattcccttgggaatttgttagaatgggcctgacacaaccaaagggagttctcctctatgggccccctggatgtgctaaaaccactctggtgagggccctggccacaagctgtcactgctctttcgtttcagtgagtggagctgatctgttttcaccgtttgttggagattcagaaaaagtgttgtctcagatatttcgacaagcaagagcaagcactccagcaattttgtttttggatgaaattgattcaatcttgggagctcgctcagccagcaagacaggatgtgatgttcaagaacgagttctttctgttctcctgaatgaattagatggtgttggacttaagacaatagagagaagaggaagtaaatcaagtcaacagggtaaatacaaggagctgaaaaaatgaagagagtttcaagaagtttttaaccgaagtgtcatgattattgcagcaacaaatagacctgatgtgttagatactgctttgttacgacctggaagattagataagatcatctatatcccacctccagatcacaagggcaggctttctattttaaaagtctgtacaaaaaccatgccaatagggcctgatgtctccttagaaaacctcgcagcagaaacctgttttttttctggagctgatcttagaaacctctgcacagaagctgctttgctggctctgcaagaaaatggactagacgcaactacagtgaaacaagagcactttctaaaatcacttaagactgtaaaaccgtcgttaagttgcaaggacttggctttatatgaaaacttatttaagaaagaaggattttctaacgtggaaggtatttaaaaatcaccttaaactcttgttcagttcacattaattgaaatgtgaacttgcctgtcgtttgcaacttcacacttttagaatttgtgtttatatttcctgtaagtgaataaataaaac

SEQ ID NO: 185698 - DNA, 362 bp, Homo sapiens
  Payload ID: 16570
  Gene Symbol: SPATA5L1
  Gene Name: spermatogenesis associated 5-like 1
  ENST ID: ENST00000525552
  CDS Start-End: 1-59
cactctgtagggaggctgccatgcatgccctccttcatagtgagaagttccaggtttgaccataagcacctctcacttaggtggaccagtcagctgctgtcgtcccagggtggagcccactgctacttcaggaggggcctgctcaggtgtagttaccacaggtgatggctgagttcagaaacaacccaggggaagtggaaggaagaaaggcaaaaagcatgaagggacagacaactgggaagaaccaggacaatcctgtgattgatgaaatagacttccttgaagcttttaaaaatattcagccctcatcgtttcgaagcgtcattggattaatggatatcaagcctgttgactgggaggag

SEQ ID NO: 185699 - DNA, 818 bp, Homo sapiens
  Payload ID: 16571
  Gene Symbol: SPATA6
  Gene Name: spermatogenesis associated 6
  ENST ID: ENST00000371841
  CDS Start-End: 70-818
attgaacaaggtggagaaggtccagaagcataccatgaactacagaagaaggaaagatggagtaatctgatgcaactggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggatgagagagacctagagaaagatgatgaactggaactgaaaagaagtcttttatgtagagactctgcctatgacagtga

SEQ ID NO: 185700 - DNA, 2297 bp, Homo sapiens
  Payload ID: 16571
  Gene Symbol: SPATA6
  Gene Name: spermatogenesis associated 6
  Uniprot ID: Q9NWH7
  ENST ID: ENST00000371843
  CDS Start-End: 3-1421
ggatgccgaaggtgaaggcgctgcagtgcgccctggcgctggagatcagctcagtaacttgcccaggagtcgtgcttaaagacaaagaggacatctatcttagcatctgtgtgtttggccaatacaaaaagacacaatgtgtcccagccacttttcccctggtcttcaatgccagaatggtgtttgaaaaggtgttcccggacgcagtagatcctggagatgtggttacacagcttgaatatgatacagcagtgttcgagttgatacagctagttccaccagtgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggatgagagagacctagagaaagatgatgaactggaactgaaaagaagtcttttatgtagagactctgcctatgacagtgaccccgagtatagctcatgtcagcagccacgtggcactttccatttggatgacggtgaatactggtccaacagggcagcctcttataagggaaaatcccaccgacccatctttgagaacagcatggacaagatgtacaggaacttatacaaaaaggcctgtagttctgcttcacatacacaggaaagcttctgagaccatccatgataaacctcattagtgtccgtgtcaatttctcaatgaaaatgtttgatgtgatcaatatctgtattcctttttttaaaaaaaatgggattataactaagtacaatagttatacttgaataagttcattacttcaaatggtaaattatcataggcaagccttttaaaataattattacagaagagtctgctgtgttacaaacattagagctctgtcacacaatcacaacttccaatatgtgacaaggatattctgttacatgtacacctcatattccatctgcaaatccaagaatagttcctttctagaaatgttttttttgccttactcaccttgcaattttcttctcatctacttaactggttatcttgcctgtgtaagatttaattaatattgactaccttttcttggtgatgaacaaaatgatatcctatacagaaatgaatttcctaagggtttaaaccctgttttcactaacattttctactttttcctttttcagaacaggctattctatttcttagctcataggctttctttttaaagactatatgatcattcactcctttttctctggaagaactgtgtaagttgcttaaaatgcatagcagttagctagaaatatcagtgccatggatgatcaaaaatttgaataactaatttttaaagataaaattctttgcatgattttttttctagggccataccttttggtgcaaccagaatcagaaaatggcctctgttagtaagcttatagaaacctaaaaataataatggaattatattgtaatttgactgcttggaatttgtgtaagtaccatatggcccaaggcactattatagtatcctcactttaaaaaaaaaaa

SEQ ID NO: 185701 - DNA, 4973 bp, Homo sapiens
  Payload ID: 16571
  Gene Symbol: SPATA6
  Gene Name: spermatogenesis associated 6
  Uniprot ID: Q9NWH7
  ENST ID: ENST00000371847
  CDS Start-End: 166-1632
gcttctccggcggaacccaggctggaccgcgggccccggcctgggggccactgctgccaccgccgccgccacctcgtctcctccccgtccccgcccagccccaggtctccccgcctcactcgggcccgtggccggggtcactccccgccgcccctccccgcacggatgccgaaggtgaaggcgctgcagtgcgccctggcgctggagatcagctcagtaacttgcccaggagtcgtgcttaaagacaaagaggacatctatcttagcatctgtgtgtttggccaatacaaaaagacacaatgtgtcccagccacttttcccctggtcttcaatgccagaatggtgtttgaaaaggtgttcccggacgcagtagatcctggagatgtggttacacagcttgaatatgatacagcagtgttcgagttgatacagctagttccaccagtgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggtaaaaaatgtcttgaaatcacatcaggctcatcaaagacatttatatgatgagagagacctagagaaagatgatgaactggaactgaaaagaagtcttttatgtagagactctgcctatgacagtgaccccgagtatagctcatgtcagcagccacgtggcactttccatttggatgacggtgaatactggtccaacagggcagcctcttataagggaaaatcccaccgacccatctttgagaacagcatggacaagatgtacaggaacttatacaaaaaggcctgtagttctgcttcacatacacaggaaagcttctgagaccatccatgataaacctcattagtgtccgtgtcaatttctcaatgaaaatgtttgatgtgatcaatatctgtattcctttttttaaaaaaaatgggattataactaagtacaatagttatacttgaataagttcattacttcaaatggtaaattatcataggcaagccttttaaaataattattacagaagagtctgctgtgttacaaacattagagctctgtcacacaatcacaacttccaatatgtgacaaggatattctgttacatgtacacctcatattccatctgcaaatccaagaatagttcctttctagaaatgttttttttgccttactcaccttgcaattttcttctcatctacttaactggttatcttgcctgtgtaagatttaattaatattgactaccttttcttggtgatgaacaaaatgatatcctatacagaaatgaatttcctaagggtttaaaccctgttttcactaacattttctactttttcctttttcagaacaggctattctatttcttagctcataggctttctttttaaagactatatgatcattcactcctttttctctggaagaactgtgtaagttgcttaaaatgcatagcagttagctagaaatatcagtgccatggatgatcaaaaatttgaataactaatttttaaagataaaattctttgcatgattttttttctagggccataccttttggtgcaaccagaatcagaaaatggcctctgttagtaagcttatagaaacctaaaaataataatggaattatattgtaatttgactgcttggaatttgtgtaagtaccatatggcccaaggcactattatagtatcctcactttaaaaaaaaaaacacttggaaccacaatgtgagtaaaatattatagcagaacgctttgtggtagacactgaaaatgttgttgattgatggatagaattaacttctcctcccccaccccagcacacacctgtgaagccaatgatactataaagacataaagaaatcagctactttatatttaatagagagtgaggggagggaaaggagagtgtaggaataagtgaactgggcttatagtcttgaagagttgcctaaaagataatattttctcattgactctgtttttgattaattttacagttatgattgaaaaagaacaaaatgaacttcctttaaaatgaaattaaaatgtgaaacttgctgacttatttttgtagtagaacttgttaacatcatgttaagggtgctttagtatcacagtctgtgatatatcagaaagggcattagagctatctctatgagccaggagtcctaggctttagtatcccatgtctgccgttttctagctgagtctatttaattctcagatcctttgtttcctcagctatcaaatgataagaatgtagtagaccccaaactatgttctgtggaccaagatcactgttttaggagataatcgtaggaatgtaggtataagtatgtaattggccatctaagtttaggaaaatctgtttgctacacacatacacacacacacacacacacacacacacacacacacacctcttagagagtcatatgtaggattatagaggtaaaaagagatgatattaatgctggaatagcgcctgtaaactggggctgtctacagcaaattaggatatatggtcactgtgctcattgtgaacagtagcttgttcgaggctttaagaaaattctggtataaatctgtcttactctgcatctagtagacagcctggcatgtaattgatgttccttaaatatttatcgaattaacccagaattttctaaactaaatttagcatgtaccactatttgttattcttgccaccaccccccattcccctagctcctcacactacctgccaatgtcatcctaaggtacatgtggatacctaggttgtagaaatgctggactacacaattgctgagttactctctggctgtagattatatgatgaggtattttacaatcagcttttgaaggtcaacattgaataatgctcttttaaaaaaattatatcctcagtgtttttccatggaaaaataagtgaaaattcttttaagagttgctgtttggtgaaaagaacaaacatgactttcaaagaaaatgttttactatcaccaaaatctcccaagtgaataagtaccacagaaattacttattgcacctgtatctgccattggctgtgaaaaaggctgcaaaaagtagggctgaaagggaaactttagaaactaatactctgaaagatgttttcctatggattaaatttagtgtctttctgaaagttgggggcaaattcccagatactaatagcatctttgctaagtgtctgattatcttctatcccctaggaggaaagagtggtccatgttgctgtaactactactatgagtgcttatgctgtattgtttttaaagagtaaaacctttaagtactaatagttgtcttttctcattcacaggagcagaaaggtgcagttgtttattctcttagccttttttttttcctgtatttcccacaaatctagaaataattattggagttaatatgaaagataaataggcttttctttttactttttaatttttttctttaaatcataaaaaaccttgggatttagaaaaatgtcaaaatcgacaaataaagatgaatcattggaatgagactcttccttggttctactagctagttatataaccttatttaagtcatttatgcttcttggagctcagttttctcaccaacaaggtgataaaagggttaatttagaatgatcctttgacatttcataattgtacaattaatatgtacgatcaggaagtcctaggcaggcagagttgttttctgatttccaaagattaagcccctgatgaaaaatctggaacaaatagagaattttcattattgtgttcatttgctaataatagctttattgagatataattcactctgaaaaagtatacaattaagtggtttttactatattcacagagttgtgcaacaataaccactcactaattacagaatattttataactcccaaaagaaatcctgtaaccattagtgatcacttcccactacctcctccccacaactcctggaaaccactatatgctttttgtctccatgcctattctggacatttcatataaatggaaccatacaacatgtgacctattgtatgtggcttctttcacttagcaaaatattttgagagttcatgcatgttgtaacacgtatgaatacttcattcctttttattactaaataataatccatcatatgaatatac

SEQ ID NO: 185702 - DNA, 4964 bp, Homo sapiens
  Payload ID: 16571
  Gene Symbol: SPATA6
  Gene Name: spermatogenesis associated 6
  ENST ID: ENST00000396199
  CDS Start-End: 201-1625
tgccatgacaacgagtctgcgccccgcgctcagctgcttctccggcggaacccaggctggaccgcgggccccggcctgggggccactgctgccaccgccgccgccacctcgtctcctccccgtccccgcccagccccaggtctccccgcctcactcgggcccgtggccggggtcactccccgccgcccctccccgcacggatgccgaaggtgaaggcgctgcagtgcgccctggcgctggagatcagctcagtaacttgcccaggagtcgtgcttaaagacaaagaggacatctatcttagcatctgtgtgtttggccaatacaaaaagacacaatgtgtcccagccacttttcccctggtcttcaatgccagaatggtgtttgaaaaggtgttcccggacgcagtagatcctggagatgtggttacacagcttgaattgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggtaaaaaatgtcttgaaatcacatcaggctcatcaaagacatttatatgatgagagagacctagagaaagatgatgaactggaactgaaaagaagtcttttatgtagagactctgcctatgacagtgaccccgagtatagctcatgtcagcagccacgtggcactttccatttggatgacggtgaatactggtccaacagggcagcctcttataagggaaaatcccaccgacccatctttgagaacagcatggacaagatgtacaggaacttatacaaaaaggcctgtagttctgcttcacatacacaggaaagcttctgagaccatccatgataaacctcattagtgtccgtgtcaatttctcaatgaaaatgtttgatgtgatcaatatctgtattcctttttttaaaaaaaatgggattataactaagtacaatagttatacttgaataagttcattacttcaaatggtaaattatcataggcaagccttttaaaataattattacagaagagtctgctgtgttacaaacattagagctctgtcacacaatcacaacttccaatatgtgacaaggatattctgttacatgtacacctcatattccatctgcaaatccaagaatagttcctttctagaaatgttttttttgccttactcaccttgcaattttcttctcatctacttaactggttatcttgcctgtgtaagatttaattaatattgactaccttttcttggtgatgaacaaaatgatatcctatacagaaatgaatttcctaagggtttaaaccctgttttcactaacattttctactttttcctttttcagaacaggctattctatttcttagctcataggctttctttttaaagactatatgatcattcactcctttttctctggaagaactgtgtaagttgcttaaaatgcatagcagttagctagaaatatcagtgccatggatgatcaaaaatttgaataactaatttttaaagataaaattctttgcatgattttttttctagggccataccttttggtgcaaccagaatcagaaaatggcctctgttagtaagcttatagaaacctaaaaataataatggaattatattgtaatttgactgcttggaatttgtgtaagtaccatatggcccaaggcactattatagtatcctcactttaaaaaaaaaaacacttggaaccacaatgtgagtaaaatattatagcagaacgctttgtggtagacactgaaaatgttgttgattgatggatagaattaacttctcctcccccaccccagcacacacctgtgaagccaatgatactataaagacataaagaaatcagctactttatatttaatagagagtgaggggagggaaaggagagtgtaggaataagtgaactgggcttatagtcttgaagagttgcctaaaagataatattttctcattgactctgtttttgattaattttacagttatgattgaaaaagaacaaaatgaacttcctttaaaatgaaattaaaatgtgaaacttgctgacttatttttgtagtagaacttgttaacatcatgttaagggtgctttagtatcacagtctgtgatatatcagaaagggcattagagctatctctatgagccaggagtcctaggctttagtatcccatgtctgccgttttctagctgagtctatttaattctcagatcctttgtttcctcagctatcaaatgataagaatgtagtagaccccaaactatgttctgtggaccaagatcactgttttaggagataatcgtaggaatgtaggtataagtatgtaattggccatctaagtttaggaaaatctgtttgctacacacatacacacacacacacacacacacacacacacacacacacctcttagagagtcatatgtaggattatagaggtaaaaagagatgatattaatgctggaatagcgcctgtaaactggggctgtctacagcaaattaggatatatggtcactgtgctcattgtgaacagtagcttgttcgaggctttaagaaaattctggtataaatctgtcttactctgcatctagtagacagcctggcatgtaattgatgttccttaaatatttatcgaattaacccagaattttctaaactaaatttagcatgtaccactatttgttattcttgccaccaccccccattcccctagctcctcacactacctgccaatgtcatcctaaggtacatgtggatacctaggttgtagaaatgctggactacacaattgctgagttactctctggctgtagattatatgatgaggtattttacaatcagcttttgaaggtcaacattgaataatgctcttttaaaaaaattatatcctcagtgtttttccatggaaaaataagtgaaaattcttttaagagttgctgtttggtgaaaagaacaaacatgactttcaaagaaaatgttttactatcaccaaaatctcccaagtgaataagtaccacagaaattacttattgcacctgtatctgccattggctgtgaaaaaggctgcaaaaagtagggctgaaagggaaactttagaaactaatactctgaaagatgttttcctatggattaaatttagtgtctttctgaaagttgggggcaaattcccagatactaatagcatctttgctaagtgtctgattatcttctatcccctaggaggaaagagtggtccatgttgctgtaactactactatgagtgcttatgctgtattgtttttaaagagtaaaacctttaagtactaatagttgtcttttctcattcacaggagcagaaaggtgcagttgtttattctcttagccttttttttttcctgtatttcccacaaatctagaaataattattggagttaatatgaaagataaataggcttttctttttactttttaatttttttctttaaatcataaaaaaccttgggatttagaaaaatgtcaaaatcgacaaataaagatgaatcattggaatgagactcttccttggttctactagctagttatataaccttatttaagtcatttatgcttcttggagctcagttttctcaccaacaaggtgataaaagggttaatttagaatgatcctttgacatttcataattgtacaattaatatgtacgatcaggaagtcctaggcaggcagagttgttttctgatttccaaagattaagcccctgatgaaaaatctggaacaaatagagaattttcattattgtgttcatttgctaataatagctttattgagatataattcactctgaaaaagtatacaattaagtggtttttactatattcacagagttgtgcaacaataaccactcactaattacagaatattttataactcccaaaagaaatcctgtaaccattagtgatcacttcccactacctcctccccacaactcctggaaaccactatatgctttttgtctccatgcctattctggacatttcatataaatggaaccatacaacatgtgacctattgtatgtggcttctttcacttagcaaaatattttgagagttcatgcatgttgtaacacgtatgaatacttcattcctttttattactaaataataatccatcatatgaatat

SEQ ID NO: 185703 - DNA, 599 bp, Homo sapiens
  Payload ID: 16571
  Gene Symbol: SPATA6
  Gene Name: spermatogenesis associated 6
  ENST ID: ENST00000487543
  CDS Start-End: 78-338
ccccgcccagccccaggtctccccgcctcactcgggcccgtggccggggtcactccccgccgcccctccccgcacggatgccgaaggtgaaggcgctgcagtgcgccctggcgctggagatcagctcagtaacttgcccaggagtcgtgcttaaagacaaagaggacatctatcttagcatctgtgtgtttggccaatacaaaaagacacaatgtgtcccagccacttttcccctggtcttcaatgccagaatggtgtttgaaaaggtgttcccggacgcagtagatcctggagatgtggttacacagcttgaatggtatctttcttgtagtgggtgaaacactgtctacgtatgacgaaaatacacgagatttcatgtttccgggtccaaaccaaatgtctggacaccatgattcaaaccgccaggttaccatgaggaggatttctggccttcgaggaaatgctccaaggctggaattttctacgacttcagtgattactgaatgtctgataagttcaaggaaatgccacactcaggataaatttatttaccatttggctccagttgaaaaatcacatggcagactgcaaaacagaac

SEQ ID NO: 185704 - DNA, 1218 bp, Homo sapiens
  Payload ID: 16571
  Gene Symbol: SPATA6
  Gene Name: spermatogenesis associated 6
  ENST ID: ENST00000603831
  CDS Start-End: 96-590
gatgtcacagagatgggtgaaatggatatggtagaaaaattctgaattactttttgaaatcattgaacaaggtggagaaggtccagaagcataccatgaactacagaagaaggaaagatggagataaatttatttaccatttggctccagttgaaaaatcacatggcagactgcaaaacagaacatcaagatcacaaaagaaaaaatccaagtcacctgagagaagtaaatactgtataaatgcaaaaaactacgaacagcctacaatttcttcaaaatcacactctccatctccctacacaaaaagacgcatgtgtgagctatctgaagacaccaggcggcggctggcccatttaaatctgggaccctatgagttcaaaaaagaaacagataaacctccatttgtgattagacatgttgatcccccaagtcccagggctgatactttattgggatcttctggaagagactgtgaaagagatggatggtcaagggtgcacaatgaatacaacagaagtgatgtgttactctcagtgcatcacactaggagatcattctcatcttggctgctgccgacccaaggattataaggttatcaggacaccccatgggagagacttcgatgactctttagaaaaatgtgaagagtatttgagcccaaggtcgtgtagtaagccccggcattcagcgaggaccttgctagtccattcagcaccctcaacaatgccaaagcattctccaagccctgtgttaaatagagcttctctcagggaaagatttcattctgattggtgttcaccttcaaactgcgatgagatccatgaccgggtaaaaaatgtcttgaaatcacatcaggctcatcaaagacatttatatgatgagagagacctagagaaagatgatgaactggaactgaaaagaagtcttttatgtagagactctgcctatgacagtgaccccgagtatagctcatgtcagcagccacgtggcactttccatttggatgacggtgaatactggtccaacagggcagcctcttataagggaaaatcccaccgacccatctttgagaacagcatggacaagatgtacaggaacttatacaaaaaggcctgtagttctgcttcacatacacaggaaagcttctgagaccatccatgataaacctcattagtgtccgtgtcaatttctcaatgaaaatgtttgatgtgatcaata

SEQ ID NO: 185705 - DNA, 1295 bp, Homo sapiens
  Payload ID: 16572
  Gene Symbol: SPATA6L
  Gene Name: spermatogenesis associated 6-like
  ENST ID: ENST00000381890
  CDS Start-End: 98-973
atttgctctaggtattcagctaaactaagaaaaattggtccaaggctcggcacaaaaggatcttctcattccagtcctttcgcccacgcagggaacgatgcctctggaggtggtggtggagctgcagatccgggcgatttcttgcccaggagtgttcctgcctggcaaacaagatgtgtacctcggggtctacctcatgaatcagtacctggagaccaacagctttccctctgcgttccccattatgattcaggagagcatgagatttgaaaaggtatttgaaagtgcagtagatcctggagctgtagtagaccttttggaaagcttcctagccaggtttgaattaatacagctagttcctccagtgtgggatgagttggcctactacgaagaaaacacacgagattttcttttcccagagcccaagctgacaccttcgcaccctaggaggtgtagggaggtgctcatgaagacggctctgggttttccaggcattgctcccaaaatagagttttctacaaggacagccatcagagaatgtgtgtttctgcatagaaacagatttcttgaagaaagacatgagtcacggaggcctttatctacatcacatgaaccaatatttcccttaaatactataaagatgaaactaaaggagaataatctcaacagactgcccaaaggcatgcaagcccgggcgccctctcaatattctaccaggcatttcttccaggaccagccagctcagttgaaccttggaaataatttcaaaatctctggaggaagcaagcctccatttgttgttagacacgtggacagtgcaaagccctttggtgagaatatttcagagcatcatttgaggaggtctagaagaaaatctaagttttcagactttccgtttccaacgagaagaggttccatcctggttctcagtccacatggaagaatatccatgagagggtatgcagtcttctgacatcccacagagcacagctgcaccaaaacaaggggaaattaatgaaagcttaaggagaatcatgaagagctcactcactgagacaattgaagcatccttaaagaaatgaacactttttgttgtctgtgttgagtcactgatgtctaatcccctttaaaccaaaccctgtactcagtcttttgtgcccaggtaagagttgttgattaaagtgtttgctgtttgggggctaacattttcttgtcaagctggaaaatttgtgtttttgcatgtttgttttgaacatgaaagagaaagcgctgtagttgggtggcaggtgcttatc

SEQ ID NO: 185706 - DNA, 1854 bp, Homo sapiens
  Payload ID: 16572
  Gene Symbol: SPATA6L
  Gene Name: spermatogenesis associated 6-like
  Uniprot ID: Q8N4H0
  ENST ID: ENST00000406861
  CDS Start-End: 200-697
actccagcttcgagtgtgagagacccgtcccggtgggagggacctgggctgggggggacggtaggggaacaagggcgtgggactggggaagcttctgggaacatttgctctaggtattcagctaaactaagaaaaattggtccaaggctcggcacaaaaggatcttctcattccagtcctttcgcccacgcagggaacgatgcctctggaggtggtggtggagctgcagatccgggcgatttcttgcccaggagtgttcctgcctggcaaacaagatgtgtacctcggggtctacctcatgaatcagtacctggagaccaacagctttccctctgcgttccccattatgattcaggagagcatgagatttgaaaaggtatttgaaagtgcagtagatcctggagctgtagtagaccttttggaaagcttcctagccaggtttgaattaatacagctagttcctccagtgtgggatgagttggcctactacgaagaaaacacacgagattttcttttcccagagcccaagctgacaccttcgcaccctaggaggtgtagggaggtgctcatgaagacggctctgggttttccaggcattgctcccaaaatagagttttctacaaggacagccatcagagaatgtgtgtttctgcatagaaacagatttcttgttgattccaaatcttggctattgtgaatagtgctgcagtaaacatggggccacctttcttttgctgaggctgatgctcggattgtattcatggtccgtctttgggctggggaaacaaagggaagatgttggttcagcaagaacacagaagcttaaagaagaaactgaacagaaatgggacccagacctctggagaagggctgctttcctggatgcttcttcaggaattcgaaggaagaaagacatgagtcacggaggcctttatctacatcacatgaaccaatatttcccttaaatactataaagatgaaactaaaggagaataatctcaacagactgcccaaaggcatgcaagcccgggcgccctctcaatattctaccaggcatttcttccaggaccagccagctcagttgaaccttggaaataatttcaaaatctctggaggaagcaagcctccatttgttgttagacacgtggacagtgcaaagccctttggtgagaatatttcagagcatcatttgaggaggtctagaagaaaatctaagttttcagactttccgtttccaacgagaagagcttcttctcttgacagccttgcagctaacgtaaaggttatcaaagagccagatgaacggattgttttaaggagtgactcatcatcatgtttagattcaagtcagtttggaaagtcttcatccagtaaacaaggggatgctgatttccacgggaaagcttcatttgccacctaccagcattccacctctcctggccccttggatcagccccttctcagagaaaggttccatcctggttctcagtccacatggaagaatatccatgagagggtatgcagtcttctgacatcccacagagcacagctgcaccaaaacaaggaagattctacctctgaagtaaattatatcattgaaagaccaagctaccctctgaagaaatactcactgcatgaacagagatatttttaaggggaaattaatgaaagcttaaggagaatcatgaagagctcactcactgagacaattgaagcatccttaaagaaatgaacactttttgttgtctgtgttgagtcactgatgtctaatcccctttaaaccaaaccctgtactcagtcttttgtgcccaggtaagagttgttgattaaagtgtttgctgtttgggggctaac

SEQ ID NO: 185707 - DNA, 1444 bp, Homo sapiens
  Payload ID: 16572
  Gene Symbol: SPATA6L
  Gene Name: spermatogenesis associated 6-like
  Uniprot ID: Q8N4H0
  ENST ID: ENST00000475086
  CDS Start-End: 239-1243
atagcaggagctgatggaaagaagatcgggattgttagcatttctctatccgtctagcacgccagacagggccagtctctccggctgggggcactgcgtgggcaacagcgaccgtgagggcgcgcgtctgcgctggggcctcgcgcgcgttccacgatgaagactgcgcgtttgagtgtccctggcaacgccacgcttccgccttctggaagcctgcactccagcttcgagtggaacgatgcctctggaggtggtggtggagctgcagatccgggcgatttcttgcccaggagtgttcctgcctggcaaacaagatgtgtacctcggggtctacctcatgaatcagtacctggagaccaacagctttccctctgcgttccccattatgattcaggagagcatgagatttgaaaagggcattgctcccaaaatagagttttctacaaggacagccatcagagaatgtgtgtttctgcatagaaacagatttcttgaagaaagacatgagtcacggaggcctttatctacatcacatgaaccaatatttcccttaaatactataaagatgaaactaaaggagaataatctcaacagactgcccaaaggcatgcaagcccgggcgccctctcaatattctaccaggcatttcttccaggaccagccagctcagttgaaccttggaaataatttcaaaatctctggaggaagcaagcctccatttgttgttagacacgtggacagtgcaaagccctttggtgagaatatttcagagcatcatttgaggaggtctagaagaaaatctaagttttcagactttccgtttccaacgagaagagcttcttctcttgacagccttgcagctaacgtaaaggttatcaaagagccagatgaacggattgttttaaggagtgactcatcatcatgtttagattcaagtcagtttggaaagtcttcatccagtaaacaaggggatgctgatttccacgggaaagcttcatttgccacctaccagcattccacctctcctggccccttggatcagccccttctcagagaaaggttccatcctggttctcagtccacatggaagaatatccatgagagggtatgcagtcttctgacatcccacagagcacagctgcaccaaaacaaggaagattctacctctgaagtaaattatatcattgaaagaccaagctaccctctgaagaaatactcactgcatgaacagagatatttttaaggggaaattaatgaaagcttaaggagaatcatgaagagctcactcactgagacaattgaagcatccttaaagaaatgaacactttttgttgtctgtgttgagtcactgatgtctaatcccctttaaaccaaaccctgtactcagtcttttgtgcccaggtaagagttgttgattaaagtgtttgctgtttgggggctaaca

SEQ ID NO: 185708 - DNA, 1843 bp, Homo sapiens
  Payload ID: 16572
  Gene Symbol: SPATA6L
  Gene Name: spermatogenesis associated 6-like
  Uniprot ID: Q8N4H0
  ENST ID: ENST00000486047
  CDS Start-End: 99-596
gacccgtcccggtgggagggacctgggctgggggggacggtaggggaacaagggcgtgggactggggaagcttctgggaacatttgctctagggaacgatgcctctggaggtggtggtggagctgcagatccgggcgatttcttgcccaggagtgttcctgcctggcaaacaagatgtgtacctcggggtctacctcatgaatcagtacctggagaccaacagctttccctctgcgttccccattatgattcaggagagcatgagatttgaaaaggtatttgaaagtgcagtagatcctggagctgtagtagaccttttggaaagcttcctagccaggtttgaattaatacagctagttcctccagtgtgggatgagttggcctactacgaagaaaacacacgagattttcttttcccagagcccaagctgacaccttcgcaccctaggaggtgtagggaggtgctcatgaagacggctctgggttttccaggcattgctcccaaaatagagttttctacaaggacagccatcagagaatgtgtgtttctgcatagaaacagatttcttgttgattccaaatcttggctattgtgaatagtgctgcagtaaacatggggccacctttcttttgctgaggctgatgctcggattgtattcatggtccgtctttggaagaaagacatgagtcacggaggcctttatctacatcacatgaaccaatatttcccttaaatactataaagatgaaactaaaggagaataatctcaacagactgcccaaaggcatgcaagcccgggcgccctctcaatattctaccaggcatttcttccaggaccagccagctcagttgaaccttggaaataatttcaaaatctctggaggaagcaagcctccatttgttgttagacacgtggacagtgcaaagccctttggtgagaatatttcagagcatcatttgaggaggtctagaagaaaatctaagttttcagactttccgtttccaacgagaagagcttcttctcttgacagccttgcagctaacgtaaaggttatcaaagagccagatgaacggattgttttaaggagtgactcatcatcatgtttagattcaagtcagtttggaaagtcttcatccagtaaacaaggggatgctgatttccacgggaaagcttcatttgccacctaccagcattccacctctcctggccccttggatcagccccttctcagagaaagacatgatttctttgcttacattattttcacaaacaatgaaaatacatttgcatatgtctggagagcaggccagagagcaaaagcagaaacctttatttgccaaacagcactctctagtagggttccatcctggttctcagtccacatggaagaatatccatgagagggtatgcagtcttctgacatcccacagagcacagctgcaccaaaacaaggaagattctacctctgaagtaaattatatcattgaaagaccaagctaccctctgaagaaatactcactgcatgaacagagatatttttaaggggaaattaatgaaagcttaaggagaatcatgaagagctcactcactgagacaattgaagcatccttaaagaaatgaacactttttgttgtctgtgttgagtcactgatgtctaatcccctttaaaccaaaccctgtactcagtcttttgtgcccaggagggaagattcttgagcccctgcaaagcaaacactgcagctggcctactgcctgagtataagccaagcacacttcccatggctcttctaagaatcagggtatgctttaataaagggccttgtacccactggactaaaaaa

SEQ ID NO: 185709 - DNA, 1747 bp, Homo sapiens
  Payload ID: 16572
  Gene Symbol: SPATA6L
  Gene Name: spermatogenesis associated 6-like
  Uniprot ID: Q8N4H0
  ENST ID: ENST00000461761
  CDS Start-End: 174-1352
gtcccggtgggagggacctgggctgggggggacggtaggggaacaagggcgtgggactggggaagcttctgggaacatttgctctaggtattcagctaaactaagaaaaattggtccaaggctcggcacaaaaggatcttctcattccagtcctttcgcccacgcagggaacgatgcctctggaggtggtggtggagctgcagatccgggcgatttcttgcccaggagtgttcctgcctggcaaacaagatgtgtacctcggggtctacctcatgaatcagtacctggagaccaacagctttccctctgcgttccccattatgattcaggagagcatgagatttgaaaaggtatttgaaagtgcagtagatcctggagctgtagtagaccttttggaaatgtgggatgagttggcctactacgaagaaaacacacgagattttcttttcccagagcccaagctgacaccttcgcaccctaggaggtgtagggaggtgctcatgaagacggctctgggttttccaggcattgctcccaaaatagagttttctacaaggacagccatcagagaatgtgtgtttctgcatagaaacagatttcttgaagaaagacatgagtcacggaggcctttatctacatcacatgaaccaatatttcccttaaatactataaagatgaaactaaaggagaataatctcaacagactgcccaaaggcatgcaagcccgggcgccctctcaatattctaccaggcatttcttccaggaccagccagctcagttgaaccttggaaataatttcaaaatctctggaggaagcaagcctccatttgttgttagacacgtggacagtgcaaagccctttggtgagaatatttcagagcatcatttgaggaggtctagaagaaaatctaagttttcagactttccgtttccaacgagaagagcttcttctcttgacagccttgcagctaacgtaaaggttatcaaagagccagatgaacggattgttttaaggagtgactcatcatcatgtttagattcaagtcagtttggaaagtcttcatccagtaaacaaggggatgctgatttccacgggaaagcttcatttgccacctaccagcattccacctctcctggccccttggatcagccccttctcagagaaaggttccatcctggttctcagtccacatggaagaatatccatgagagggtatgcagtcttctgacatcccacagagcacagctgcaccaaaacaaggaagattctacctctgaagtaaattatatcattgaaagaccaagctaccctctgaagaaatactcactgcatgaacagagatatttttaaggggaaattaatgaaagcttaaggagaatcatgaagagctcactcactgagacaattgaagcatccttaaagaaatgaacactttttgttgtctgtgttgagtcactgatgtctaatcccctttaaaccaaaccctgtactcagtcttttgtgcccaggaacggacactcactgaaattggaattttgaactgagataaacatcatacttgttttattgggatgacttccaggaacagaccgtaggcagtggcagagggaagattcttgagcccctgcaaagcaaacactgcagctggcctactgcctgagtataagccaagcacacttcccatggctcttctaagaatcagggtatgctttaataaagggccttgtacccactggactaaaaaa

SEQ ID NO: 185710 - DNA, 2437 bp, Homo sapiens
  Payload ID: 16572
  Gene Symbol: SPATA6L
  Gene Name: spermatogenesis associated 6-like
  ENST ID: ENST00000485616
  CDS Start-End: 81-653
gaagactgcgcgtttgagtgtccctggcaacgccacgcttccgccttctggaagcctgcactccagcttcgagtggaacgatgcctctggaggtggtggtggagctgcagatccgggcgatttcttgcccaggagtgttcctgcctggcaaacaagatgtgtacctcggggtctacctcatgaatcagtacctggagaccaacagctttccctctgcgttccccattatgattcaggagagcatgagatttgaaaaggtatttgaaagtgcagtagatcctggagctgtagtagaccttttggaaatgtgggatgagttggcctactacgaagaaaacacacgagattttcttttcccagagcccaagctgacaccttcgcaccctaggaggtgtagggaggtgctcatgaagacggctctgggttttccaggcattgctcccaaaatagagttttctacaaggacagccatcagagaatgtgtgtttctgcatagaaacagatttcttggctggggaaacaaagggaagatgttggttcagcaagaacacagaagcttaaagaagaaactgaacagaaatgggacccagacctctggagaagggctgctttcctggatgcttcttcaggaattcgaaggaagaaagacatgagtcacggaggcctttatctacatcacatgaaccaatatttcccttaaatactataaagatgaaactaaaggagaataatctcaacagactgcccaaaggcatgcaagcccgggcgccctctcaatattctaccaggcatttcttccaggaccagccagctcagttgaaccttggaaataatttcaaaatctctggaggaagcaagcctccatttgttgttagacacgtgagcctaaaattattttttagagcattttgcaatagtgaggatatggatgagggtggaagaaaggaaggttgagttataacaacaaatgaataatattcaataaaaaggtggacagtgcaaagccctttggtgagaatatttcagagcatcatttgaggaggtctagaagaaaatctaagttttcagactttccgtttccaacgagaagaggttccatcctggttctcagtccacatggaagaatatccatgagagggtatgcagtcttctgacatcccacagagcacagctgcaccaaaacaaggaagattctacctctgaagtaaattatatcattgaaagaccaagctaccctctgaagaaatactcactgcatgaacagagatatttttaaggggaaattaatgaaagcttaaggagaatcatgaagagctcactcactgagacaattgaagcatccttaaagaaatgaacactttttgttgtctgtgttgagtcactgatgtctaatcccctttaaaccaaaccctgtactcagtcttttgtgcccaggttttaagctccatgaaggcaggagacctagctatctgcttgttcacgaatgtatactcagtgcccagcacataggagatgctcagtaaacatgctgattgaatgactaacaggtatttaagtatggctgactgccctggatccctctcccaggctctggccccttggcagcagagtgttgccagaacaaaacttgccagttccagctgctgcccttatgatctgtgtgatcttgaaaaagtggcttaatctgtcttcaacctcctgtttccttatctctaaagatggagttaaggtcccacctacttgatgacttcatagggctgctatgaggattaaataaacaggttcatgatttttaaattccaaaatgtttcttttattccccagagaaaacaaggcaggatatgatcttactttgttaatccagggcatagggaaatctctgcagccttgattagtactccctggatgttcaaagggaaaggaagaggcaaagaggagcatgcaaaatctttctgtgcatgcatcacctatgacatctacttttcttagagacatgaagaactctcttaaaataggtaatatcaccactctaggctatttggtgatgttaacaaaataaactggtccttgagcagaatcagctaaaggtccccttgaagcctctgtcagctggtccacatttgaagttcaaaacatgcatcaagaagcagtgggctctccaggtgcagtggttcatgcctgtaatcccagcactttgggaggctgaggcaagtggatcacttgaggtcaggagttcaagaccagcctggccaacatggtgtaacctcatctctactaaaaatacaaaaattagccggtggtggtggcacacacctatagtcccagctacttgggaggctgaggcaggagaatcgcttgaacccaggaggtggaggttgcaagtgagctgagatcgcaccactgcactccagcctgggcaacacagtgagactctgtc

SEQ ID NO: 185711 - DNA, 1410 bp, Homo sapiens
  Payload ID: 16573
  Gene Symbol: SPATA7
  Gene Name: spermatogenesis associated 7
  Uniprot ID: Q9P0W8
  ENST ID: ENST00000045347
  CDS Start-End: 1-1377
atggatggcagccggagagtcagagcaacctctgtccttcccagatatggtccaccgtgcctatttaaaggacacttgagcaccaaaagtaatgctttttgcactgactcctcttctctcagactaagcactctccagctggtcaagaatcacatggctgttcactataataaaatcctttcagccaaagctgcagtagactgctcggttccagtaagcgtgagtaccagcataaagtatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcgttctccagtgtcaaaggcgacaataatcatgacatggagttatcaactcttaaaatcatggaaatgagcattgaggactgccctttggatgtttaatcttcattaataaatacctcaaatggccagtaa

SEQ ID NO: 185712 - DNA, 1891 bp, Homo sapiens
  Payload ID: 16573
  Gene Symbol: SPATA7
  Gene Name: spermatogenesis associated 7
  Uniprot ID: Q9P0W8
  ENST ID: ENST00000356583
  CDS Start-End: 152-1855
cccttagcaacggcctggcaacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctgcagtagactgctcggttccagtaagcgtgagtaccagcataaagtatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaactc

SEQ ID NO: 185713 - DNA, 2123 bp, Homo sapiens
  Payload ID: 16573
  Gene Symbol: SPATA7
  Gene Name: spermatogenesis associated 7
  Uniprot ID: Q9P0W8
  ENST ID: ENST00000393545
  CDS Start-End: 290-2089
gactggggctcgatgccccttccccgccaggtctctccgtccgcaactgtcctcctagtaccgggtatcccgcaggcggggctgcggaacgcacgtcccctgcgccgtgacgtcacaatagcgactcactggacccagcccttagcaacggcctggcaacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctttttgcactgactcctcttctctcagactaagcactctccagctggtcaagaatcacatggctgttcactataataaaatcctttcagccaaagctgcagtagactgctcggttccagtaagcgtgagtaccagcataaagtatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaac

SEQ ID NO: 185714 - DNA, 890 bp, Homo sapiens
  Payload ID: 16573
  Gene Symbol: SPATA7
  Gene Name: spermatogenesis associated 7
  ENST ID: ENST00000555534
  CDS Start-End: 171-428
agcgactcactggacccagcccttagcaacggcctggcaacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctttttgcactgactcctcttctctcagactaagcactctccagctggtcaagaatcacatggctgttcactataataaaatcctttcagccaaagctgcagtagactgctcggttccagtaagcgtgagtaccagcataaagtgtctagaagtacttgtatgaatctgggtgctccagtgttgggtgcaaatatacctaggatagatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaag

SEQ ID NO: 185715 - DNA, 805 bp, Homo sapiens
  Payload ID: 16573
  Gene Symbol: SPATA7
  Gene Name: spermatogenesis associated 7
  ENST ID: ENST00000553885
  CDS Start-End: 122-805
tgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctgcagtagactgctcggttccagtaagcgtgagtaccagcataaagtgtatacatgtgccatggtggtttgctgcacccatcaacctgtcatctacattagatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcct

SEQ ID NO: 185716 - DNA, 592 bp, Homo sapiens
  Payload ID: 16573
  Gene Symbol: SPATA7
  Gene Name: spermatogenesis associated 7
  ENST ID: ENST00000555356
  CDS Start-End: 147-287
agcaacggcctggcaacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagaggtaaagggcagctgtcaggggctaccgccgcctcgcccctcgctccaggcggcgctcccagcctcgggtccgggcagctgagtgcaaggccgccccttggggcgcttcctacccctggctgagtcgccagtgttgcctggagctgcccaggcctgcgcaaaggaagagggagagcctgcttgccagcctcgcagtcagagcaacctctgtccttcccagatatggtccaccgtgcctatttaaaggacacttgagcaccaaaagtaatgctgcagtagactgctcggttccagtaagcgtgagtaccagcataaagtgtatttagcactgtaaacttgcctcttaacactgcttttgctgcatcccagaaattttgatgcagaccaacaacgaagagagaaactcaaaaaggaattagcacaatgtg

SEQ ID NO: 185717 - DNA, 758 bp, Homo sapiens
  Payload ID: 16573
  Gene Symbol: SPATA7
  Gene Name: spermatogenesis associated 7
  ENST ID: ENST00000556406
  CDS Start-End: 1-275
gggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcggtcaggattccagatgattaacattaactgttcttcagaggctgagaaaatcacttaagagaaataagtacctacctcttctgctgtcaccattgctataattgcaattccctgttcccataccatctgccaaaaatcttgacaggtattctgtaatggtccctgtgtggcaatataatcccattcgattccactgacagagacctgggattagaaaaggttaaaaaaattgatgtgtgggtataatatacataggtatgtatgcatgcattcatggtagtactaaaaaagtttttttaaaaaagtaaaaagtaaaaaagtagtaaactggattattcagcagaataaggaaagacttttcatcttttcccttgtgaatacaatttgcattactgacatttttataaacttaggtactgtgaatatacataatatctatgcaacctgtttaaccttgctgaatgtcagttctcatttatacaataaagatactgcctaccgtca

SEQ ID NO: 185718 - DNA, 1088 bp, Homo sapiens
  Payload ID: 16573
  Gene Symbol: SPATA7
  Gene Name: spermatogenesis associated 7
  ENST ID: ENST00000555515
  CDS Start-End: 142-387
cggcctggcaacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctttttgcactgactcctcttctctcagactaagcactctccagctggtcaagaatcacatggctgttcactataataaaatcctttcagccaaagctgcagtagactgctcggttccagtaagcgtgagtaccagcataaagtgtatttagcactgtaaacttgcctcttaacactgcttttgctgcatcccagaaattttggtctagaagtacttgtatgaatctgggtgctccagtgttgggtgcaaatatacctaggatagatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctg

SEQ ID NO: 185719 - DNA, 401 bp, Homo sapiens
  Payload ID: 16573
  Gene Symbol: SPATA7
  Gene Name: spermatogenesis associated 7
  ENST ID: ENST00000554802
  CDS Start-End: 1-231
agtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcgattccagatgctgctactactggtccgaaaacaaccccactggaagatgaataaagtggacacaacaaatagcatatgttctactatagaggtggccacatgaagagctctgcaagcccactgtgaaattgatagcaaatctttattcaagtgtattaattgacccacaaatatcctgattaatgaagctggctagtttggcaagatgcattctaactcttaaa

SEQ ID NO: 185720 - DNA, 2301 bp, Homo sapiens
  Payload ID: 16573
  Gene Symbol: SPATA7
  Gene Name: spermatogenesis associated 7
  Uniprot ID: Q9P0W8
  ENST ID: ENST00000556553
  CDS Start-End: 560-2263
aacagttcatagggacagcacccccacaacagagaattatacaaccagcccaaaatgtcaatggacatttgggctgagaagtcttacatgacagaatgcttcctaccctgatctgacgttatttccaaggattcaaaggggacgtggatgccagatgagtccacctcctctccctgctcttcccgcagggacagagcctgccaggtgctggtgactcggatcctgacaggaggtcgctctgcggaagactggcaggatcccagagcaacagactggggctcgatgccccttccccgccaggtctctccgtccgcaactgtcctcctagtaccgggtatcccgcaggcggggctgcggaacgcacgtcccctgcgccgtgacgtcacaatagcgactcactggacccagcccttagcaacggcctggcaacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctgcagtagactgctcggttccagtaagcgtgagtaccagcataaagtatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacagaagcaaaatctttcctgtcacagtatcgctattatacacctgccaaaagaaaaaaggattttacagatcaacggatagaagctgaaacccagactgaattaagctttaaatctgagttggggacagctgagactaaaaacatgacagattcagaaatgaacataaagcaggcatctaattgtgtgacatatgatgccaaagaaaaaatagctcctttacctttagaagggcatgactcaacatgggatgagattaaggatgatgctcttcagcattcctcaccaagggcaatgtgtcagtattccctgaagcccccttcaactcgtaaaatctactctgatgaagaagaactgttgtatctgagtttcattgaagatgtaacagatgaaattttgaaacttggtttattttcaaacaggtttttagaacgactgttcgagcgacatataaaacaaaataaacatttggaggaggaaaaaatgcgccacctgctgcatgtcctgaaagtagacttaggctgcacatcggaggaaaactcggtaaagcaaaatgatgttgatatgttgaatgtatttgattttgaaaaggctgggaattcagaaccaaatgaattaaaaaatgaaagtgaagtaacaattcagcaggaacgtcaacaataccaaaaggctttggatatgttattgtcggcaccaaaggatgagaacgagatattcccttcaccaactgaatttttcatgcctatttataaatcaaagcattcagaaggggttataattcaacaggtgaatgatgaaacaaatcttgaaacttcaactttggatgaaaatcatccaagtatttcagacagtttaacagatcgggaaacttctgtgaatgtcattgaaggtgatagtgaccctgaaaaggttgagatttcaaatggattatgtggtcttaacacatcaccctcccaatctgttcagttctccagtgtcaaaggcgacaataatcatgacatggagttatcaactcttaaaatcatggaaatgagcattgaggactgccctttggatgtttaatcttcattaataaatacctcaaatggccagtaactcaa

SEQ ID NO: 185721 - DNA, 545 bp, Homo sapiens
  Payload ID: 16573
  Gene Symbol: SPATA7
  Gene Name: spermatogenesis associated 7
  ENST ID: ENST00000555715
  CDS Start-End: 147-275
agcaacggcctggcaacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatggcgttcttgagattagagaattttggagtctatgatttcaaactattattgtgccctggatgtggacttggctgtctcctgctcccagctgctacagcagcccagctctacttttgccaggaaactaccctgatttaaggcatacctgccttgttaaaatgctttttgcactgactcctcttctctcagactaagcactctccagctggtcaagaatcacatggctgttcactataataaaatcctttcagccaaagctgcagtagactgctcggttccagtaagcgtgagtaccagcataaagt

SEQ ID NO: 185722 - DNA, 651 bp, Homo sapiens
  Payload ID: 16573
  Gene Symbol: SPATA7
  Gene Name: spermatogenesis associated 7
  ENST ID: ENST00000554168
  CDS Start-End: 182-322
gacgtcacaatagcgactcactggacccagcccttagcaacggcctggcaacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagaggtaaagggcagctgtcaggggctaccgccgcctcgcccctcgctccaggcggcgctcccagcctcgggtccgggcagctgagtgcaaggccgccccttggggcgcttcctacccctggctgagtcgccagtgttgcctggagctgcccaggcctgcgcaaaggaagagggagagcctgcttgccagcctcgcagtcagagcaacctctgtccttcccagatatggtccaccgtgcctatttaaaggacacttgagcaccaaaagtaatgctgcagtagactgctcggttccagtaagcgtgagtaccagcataaagtatgcagaccaacaacgaagagagaaactcaaaaaggaattagcacaatgtgaaaaagagttcaaattaactaaaactgcaatgcgagccaattataaaaataattccaagtcactttttaataccttacaaaag

SEQ ID NO: 185723 - DNA, 804 bp, Homo sapiens
  Payload ID: 16573
  Gene Symbol: SPATA7
  Gene Name: spermatogenesis associated 7
  ENST ID: ENST00000557248
  CDS Start-End: 81-341
actgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctttttgcactgactcctcttctctcagactaagcactctccagctggtcaagaatcacatggctgttcactataataaaatcctttcagccaaagctgcagtagactgctcggttccagtaagcatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcacccagtggggatcttttggataaacattctgaactcttttctaacaaacaattgccattcactcctcgcactttaaaaacaga

SEQ ID NO: 185724 - DNA, 786 bp, Homo sapiens
  Payload ID: 16573
  Gene Symbol: SPATA7
  Gene Name: spermatogenesis associated 7
  ENST ID: ENST00000556870
  CDS Start-End: 176-337
acaatagcgactcactggacccagcccttagcaacggcctggcaacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctgcagtagactgctcggttccagtaagcgtgagtaccagcataaagtgtctagaagtacttgtatgaatctgggtgctccagtgttgggtgcaaatatacctaggatagatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagtta

SEQ ID NO: 185725 - DNA, 568 bp, Homo sapiens
  Payload ID: 16573
  Gene Symbol: SPATA7
  Gene Name: spermatogenesis associated 7
  ENST ID: ENST00000557724
  CDS Start-End: 147-287
agcaacggcctggcaacggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagaggtaaagggcagctgtcaggggctaccgccgcctcgcccctcgctccaggcggcgctcccagcctcgggtccgggcagctgagtgcaaggccgccccttggggcgcttcctacccctggctgagtcgccagtgttgcctggagctgcccaggcctgcgcaaaggaagagggagagcctgcttgccagcctcgcagtcagagcaacctctgtccttcccagatatggtccaccgtgcctatttaaaggacacttgagcaccaaaagtaatgctttttgcactgactcctcttctctcagactaagcactctccagctggtcaagaatcacatggctgttcactataataaaatcctttcagccaaagctgcagtagactgctcggttccagtaagcgtgagtacc

SEQ ID NO: 185726 - DNA, 545 bp, Homo sapiens
  Payload ID: 16573
  Gene Symbol: SPATA7
  Gene Name: spermatogenesis associated 7
  ENST ID: ENST00000555401
  CDS Start-End: 130-545
ggtttccctgctgctgcagcccccgtcggctcctcttttccagtcctccactgccggggctgggcccggccgcgggaaggaccgaaggggatacagcgtgtccctgcggcggctgcaagaggactaagcatggatggcagccggagagctgcagtagactgctcggttccagtaagcgtgagtaccagcataaagtatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctgg

SEQ ID NO: 185727 - DNA, 761 bp, Homo sapiens
  Payload ID: 16573
  Gene Symbol: SPATA7
  Gene Name: spermatogenesis associated 7
  ENST ID: ENST00000553908
  CDS Start-End: 76-225
cggggctgggcccggccgcgggaaggaccgaaggggatacagcgtgtccctgcggcggctgcaagaggactaagcatggatggcagccggagagtcagagcaacctctgtccttcccagatatggtccaccgtgcctatttaaaggacacttgagcaccaaaagtaatgctgcagtagactgctcggttccagtaagcgtgagtaccagcataaagtgtatttagcactgtaaacttgcctcttaacactgcttttgctgcatcccagaaattttggtctagaagtacttgtatgaatctgggtgctccagtgttgggtgcaaatatacctaggatagatgcagaccaacaacgaagagagaaactcaaaaaggaattagcacaatgtgaaaaagagttcaaattaactaaaactgcaatgcgagccaattataaaaataattccaagtcactttttaataccttacaaaagccctcaggcgaaccgcaaattgaggatgacatgttaaaagaagaaatgaatggattttcatcctttgcaaggtcactagtaccctcttcagagagactacacctaagtctacataaatccagtaaagtcatcacaaatggtcctgagaagaactccagttcctccccgtccagtgtggattatgcagcctccgggccccggaaactgagctctggagccctgtatggcagaaggcccagaagcacattcccaaattcccaccggtttcagttagtcatttcgaaagcac

SEQ ID NO: 185728 - DNA, 1083 bp, Homo sapiens
  Payload ID: 16574
  Gene Symbol: SPATA8
  Gene Name: spermatogenesis associated 8
  Uniprot ID: Q6RVD6
  ENST ID: ENST00000328504
  CDS Start-End: 268-585
agttgcgtccgttggggcttctggggcagcccacagggttccgagcatgtgctggcagttgctctttggagcacccacttcacttctcccatgtagttcctgagtgcaggactctcctgaagaaggggcgtctaaaaggccagcccatgcatcttgttcagaccaggctgctccatctccgctaagcccagggatccacttgtgtgtctttctgggataattgtctttagtggcagcctgggcctcggggaaggaagggcatgaggaatggccccggctgggatgtcaggggcccaggacaactcctgtctctaccaggaaattgccccctcttttcagaggctgccttgtcctagaacctcgtcgcgacatttctcagaagccatgacatgtccctgcggctggaggcctttcaagggtggcccaggaggcctcaagggcccggtgtggcctgcaaaggaagagaacagctgttctcacggaaggatccaaagggttcaaaggcgaagggtgccatctgcttccccactgattcagaagataaacaggagaagtgtcctgtttcacccatattgctggtcctgatttttcaatagtgtccctaccctgaagctcttccattggtcatcatggagttagctaacagcccagggaactggtctcttttcccttttcccttaccacctggaactcacctggaaagggcaatcagctggctctatatcagacgccaccacctggtctttgaagtttctgtcctaccagtgccacagctccctctcccacttctgaactacctccaagagagaccatcctcagcagcctagtatgttatgctagtcctggaatggtgtattctggatgtctactcaaggccaaaccccagtattgcctttcgtttccctattcaaggccaaggctagattctcttcattgtctccatttctctttctccagagctcctatagggcaagacactgtttctcatatatttctggatccttggagcttagctcggagcttggcatacatgcccagcatgaacttttctgaataaaataatttcaaatgctgtatacagga

SEQ ID NO: 185729 - DNA, 406 bp, Homo sapiens
  Payload ID: 16574
  Gene Symbol: SPATA8
  Gene Name: spermatogenesis associated 8
  ENST ID: ENST00000558553
  CDS Start-End: 150-356
ctcccatgtagttcctgagtgcaggactctcctgaagaaggggcgtctaaaaggccagcccatgcatcttgttcagaccaggctgctccatctccgctaagcccagggatccacttaacctcgtcgcgacatttctcagaagccatgacatgtccctgcggctggaggcctttcaagggtggcccaggaggcctcaagggcccggtgtggcctgcaaaggaagagaacagctgttctcacggaaggatccaaagggttcaaaggcgaagggtgccatctgcttccccactgattcagaagataaacaggagaagtgtcctgtttcacccatattgctggtcctgatttttcaatagtgtccctaccctgaagctcttccattggtcatcatggagttagctaacag

SEQ ID NO: 185730 - DNA, 1100 bp, Homo sapiens
  Payload ID: 16575
  Gene Symbol: SPATA9
  Gene Name: spermatogenesis associated 9
  Uniprot ID: Q9BWV2
  ENST ID: ENST00000274432
  CDS Start-End: 143-907
ccagcagtgagctgtgagttctgtccttgctggctttcccaagtggaaggctaccctcatctttcactaatggcagactaggacaagcattacccaggcctgcaagcttgttaaggactaggaacccaagcaagaactcaccatgccaatcaaacctgttgggtggatatgtgggcaggtgttgaagaacttttctggaagaatcgaggggatccagaaagcaatcatggaccttgtagatgagtttaaagatgaatttcccaccatcctaagattatcacagtctaatcagaaaagagaacctgcgcagaaaacatccaaaatcaggatggctattgctttagctaagattaatcgagcaacattaattcgtggattaaacagcatatccagatcctccaaatcagtggccaaacttctgcatcctcagcttgcatgcagacttttagagctaagggacatatctggtcgtctgctgagggaagttaatgcgccgaggcaacccctatataacattcaggtcagaaagggttctttgtttgaaatcatctcctttccagcaaagactgctttaactagcataatatatgcttcatatgcagcactaatttatttggcagtctgtgttaatgctgtgctgaagaaggtaaagaacatcttccaggaagaagaatccataaggcaaaacagagaggagagtgaaaattgtagaaaagccttttctgagcctgtgctttcggagcctatgtttgctgaaggtgaaatcaaagcaaaaccttataggtcattgccggagaagccagacatttcagattaccccaagcttcttgctaataagcagagtaataacatccaagttttacattctgtgtttgaccaatcagctgaaatgaatgagcaaatctgaatacaggtatcactgaacagaacttaagagttatctatttaatggcacatttcatctgacaaaactcagagtctagtttacatattctgaattgctctgctttcttaaaaaaaagagaagggggctactattaaaatgtcattttctagtatttacatgatagagtaaataaaatgaatattgatgtggaata

SEQ ID NO: 185731 - DNA, 1583 bp, Homo sapiens
  Payload ID: 16575
  Gene Symbol: SPATA9
  Gene Name: spermatogenesis associated 9
  Uniprot ID: Q9BWV2
  ENST ID: ENST00000316087
  CDS Start-End: 143-907
ccagcagtgagctgtgagttctgtccttgctggctttcccaagtggaaggctaccctcatctttcactaatggcagactaggacaagcattacccaggcctgcaagcttgttaaggactaggaacccaagcaagaactcaccatgccaatcaaacctgttgggtggatatgtgggcaggtgttgaagaacttttctggaagaatcgaggggatccagaaagcaatcatggaccttgtagatgagtttaaagatgaatttcccaccatcctaagattatcacagtctaatcagaaaagagaacctgcgcagaaaacatccaaaatcaggatggctattgctttagctaagattaatcgagcaacattaattcgtggattaaacagcatatccagatcctccaaatcagtggccaaacttctgcatcctcagcttgcatgcagacttttagagctaagggacatatctggtcgtctgctgagggaagttaatgcgccgaggcaacccctatataacattcaggtcagaaagggttctttgtttgaaatcatctcctttccagcaaagactgctttaactagcataatatatgcttcatatgcagcactaatttatttggcagtctgtgttaatgctgtgctgaagaaggtaaagaacatcttccaggaagaagaatccataaggcaaaacagagaggagagtgaaaattgtagaaaagccttttctgagcctgtgctttcggagcctatgtttgctgaaggtgaaatcaaagcaaaaccttataggtcattgccggagaagccagacatttcagattaccccaagcttcttgctaataagcagagtaataacatccaagttttacattctgtgtttgaccaatcagctgaaatgaatgagcaaatctgaatacaggcattcaaagaacattggctcactgaataggagactttacatctctcatggctgggcagcagctgtgtctggcttccttacttcaagatctgccttgatcacagatcacttaacagtggttaagtttcttattttcaagttcagcaggggcaaactatacacggtcgtccatcaaaatcctggggaagagaataactcatttaatattctgacatgtcaaatgttcttgatagactctgaagagtctgctgcagaagaaccaggttaaaaaaacagtaggtctaaggggttggggtgacaagattctgcatgtctaagaagctcccatgtgacaccaaagttgctggtctatggacaacagtttgaggagcaaggtcttcaagctctcattatggactgaaactggagaaaattctatggaactattatcagctcacacatataaaaactggtcactgagatgacagctgagctgaaatgcccaaaatgcaaatgaactagacatgccaacagcttggggaagagaattccatactgaaagaagagcaaatacaaaagcctgaaggaaagaaaagtcttggtgaatgtgttccagaagactggaacataatatgcaagattggtaaacaggcaggagccaggttgtgcagtgctgtgtatggattttact

SEQ ID NO: 185732 - DNA, 1046 bp, Homo sapiens
  Payload ID: 16575
  Gene Symbol: SPATA9
  Gene Name: spermatogenesis associated 9
  Uniprot ID: Q9BWV2
  ENST ID: ENST00000489917
  CDS Start-End: 157-564
agtaacaaagaattccagcagtgagctgtgagttctgtccttgctggctttcccaagtggaaggctaccctcatctttcactaatggcagactaggacaagcattacccaggcctgcaagcttgttaaggactaggaacccaagcaagaactcaccatgccaatcaaacctgttgggtggatatgtgggcaggtgttgaagaacttttctggaagaatcgaggggatccagaaagcaatcatggaccttgtagatgagtttaaagatgaatttcccaccatcctaagattatcacagtctaatcagaaaagagaacctgcgcagaaaacatccaaaatcaggatggctattgctttagctaagattaatcgagcaacattaattcgtggattaaacagcatatccagatcctccaaatcagtggccaaacttctgcatcctcagcttgcatgcagacttttagagctaagggacatatctggtcgtctgctgagggaagttaatgcgccgaggcaacccctatataacattcaggagaagaaaatggggctccaattgagttaaaccaaaaaagaagatgtattagctcccataaacaacccagagctgttgagattcccgacatggctggatacaggtcagaaagggttctttgtttgaaatcatctcctttccagcaaagactgctttaactagcataatatatgcttcatatgcagcactaatttatttggcagtctgtgttaatgctgtgctgaagaaggtaaagaacatcttccaggaagaagaatccataaggcaaaacagagaggagagtgaaaattgtagaaaagccttttctgagcctgtgctttcggagcctatgtttgctgaaggtgaaatcaaagcaaaaccttataggtcattgccggagaagccagacatttcagattaccccaagcttcttgctaataagcagagtaataacatccaagttttacattctgtgtttgaccaatcagctgaaatgaatgagcaaatctgaatacaggtatcactgaacagaa

SEQ ID NO: 185733 - DNA, 2169 bp, Homo sapiens
  Payload ID: 16575
  Gene Symbol: SPATA9
  Gene Name: spermatogenesis associated 9
  Uniprot ID: Q9BWV2
  ENST ID: ENST00000477715
  CDS Start-End: 157-693
agtaacaaagaattccagcagtgagctgtgagttctgtccttgctggctttcccaagtggaaggctaccctcatctttcactaatggcagactaggacaagcattacccaggcctgcaagcttgttaaggactaggaacccaagcaagaactcaccatgccaatcaaacctgttgggtggatatgtgggcaggtgttgaagaacttttctggaagaatcgaggggatccagaaagcaatcatggaccttgtagatgagtttaaagatgaatttcccaccatcctaagattatcacagtctaatcaggtcagaaagggttctttgtttgaaatcatctcctttccagcaaagactgctttaactagcataatatatgcttcatatgcagcactaatttatttggcagtctgtgttaatgctgtgctgaagaaggtaaagaacatcttccaggaagaagaatccataaggcaaaacagagaggagagtgaaaattgtagaaaagccttttctgagcctgtgctttcggagcctatgtttgctgaaggtgaaatcaaagcaaaaccttataggtcattgccggagaagccagacatttcagattaccccaagcttcttgctaataagcagagtaataacatccaagttttacattctgtgtttgaccaatcagctgaaatgaatgagcaaatctgaatacaggcattcaaagaacattggctcactgaataggagactttacatctctcatggctgggcagcagctgtgtctggcttccttacttcaagatctgccttgatcacagatcacttaacagtggttaagtttcttattttcaagttcagcaggggcaaactatacacggtcgtccatcaaaatcctggggaagagaataactcatttaatattctgacatgtcaaatgttcttgatagactctgaagagtctgctgcagaagaaccaggttaaaaaaacagtaggtctaaggggttggggtgacaagattctgcatgtctaagaagctcccatgtgacaccaaagttgctggtctatggacaacagtttgaggagcaaggtcttcaagctctcattatggactgaaactggagaaaattctatggaactattatcagctcacacatataaaaactggtcactgagatgacagctgagctgaaatgcccaaaatgcaaatgaactagacatgccaacagcttggggaagagaattccatactgaaagaagagcaaatacaaaagcctgaaggaaagaaaagtcttggtgaatgtgttccagaagactggaacataatatgcaagattggtaaacaggcaggagccaggttgtgcagtgctgtgtatggattttactctaagagcaaaggaaagccactgaagagtataaagcaggaaagtgtgaattgatttctttttgaaagaatgctcccggctctgtggagaatggattatagcaaaacaacaatggatgcccagaaatcagaaagctaggggtccatgaaaaaggtggtggcttgccgcagggggttgatgctgtaggggataaaaagtaataacaacagtagcagtagtagctacaattatattgtgttaactatgtgccaggcactattcaaaggctacatttatttattaactcctttaatcctccatgttactaaaaaggtattattttaattttatagtacagagaagttgggttgatgaacttgaatgaagatgctacagaaaaataaataaagatgactcccaagttttaggtttgtgcagctaggtgaactgtagtgccaaagactgtgaggagaaaggccaagaaatgaatggtatttttgcagaatggaaaatcaagagctatatatattttacacatattgagtttaaggtatctcagagacatccaagtagagatgtcaagtcaacaaccagatatatgagactaaagtcgagaatttctagagagaaaaactggggagtttccaggtcatagaattctatggactcacttggagaggaagtgtagataaggaagaaggtctaagacaattcctgaaacacttcaacatttagaggtcaggtggaagagaggttgtagagaggcaagatcagtagagtgtccaatctattgctaatcaaatgaaattcattcacagcttt

SEQ ID NO: 185734 - DNA, 455 bp, Homo sapiens
  Payload ID: 16576
  Gene Symbol: SPATS1
  Gene Name: spermatogenesis associated, serine-rich 1
  ENST ID: ENST00000515220
  CDS Start-End: 102-455
tctgtgggagaagcaggcggctgcggtgtcccttttgccctaggctctcggttctcaggcctcggcgtgcggcgtgcgttcggcagttcagttgccagttgatgagtccatccatgctcactggaaacagtccacggggctgccgtctcccctccatctcaagcacgacctgcggcagacagctggagaaggttccagaaaaaagggactctggcatgaccgaggtggagaggacctacagtgctaattgcagtgattttctggaatctaagggatgttttgccaacacaacaccctctggcaaaagtgtcagttcctcatcttctgtggaaacaggcccaagtgtcagtgagcctcctggcctccccagagtgtctgcttacgtagacaccactgctgacttggatcggaaactctccttctcacattctgatcactcctctgaaatgtcgttg

SEQ ID NO: 185735 - DNA, 1354 bp, Homo sapiens
  Payload ID: 16576
  Gene Symbol: SPATS1
  Gene Name: spermatogenesis associated, serine-rich 1
  Uniprot ID: Q496A3
  ENST ID: ENST00000288390
  CDS Start-End: 348-1250
agttgccagttggttcgttggtccgtggaggcctctgagcacagacccgggcctcccctggggaagggggtgggaagaccccgaggtggaaaagaaggagcaccttgagctggatgggggctgcagcgagcctggttcgggctgggggcggactcgctggggctcccagggcttccaaaccacgaaacgcccaggtggagggagtaaggctcccgtttagaggccagtcctgccctcctgactttcggtggcttgtggaatttgtttgttttgactgatacctttcttacgagggactttctttgtctctgggttgcttctaatatttaaaatcatcatgggcacagatgagtccatccatgctcactggaaacagtccacggggctgccgtctcccctccatctcaagcacgacctgcggcagacagctggagaaggttccagaaaaaagggactctggcatgaccgaggtggagaggacctacagtgctaattgcagtgattttctggaatctaagggatgttttgccaacacaacaccctctggcaaaagtgtcagttcctcatcttctgtggaaacaggcccaagtgtcagtgagcctcctggcctccccagagtgtctgcttacgtagacaccactgctgacttggatcggaaactctccttctcacattctgatcactcctctgaaatgtcgttgcctgaagtccaaaaggataaatatcctgaggaattcagcctgcttaagttgcagacgaaagatgggcatcgtcctgagtggacattttacccaaggtttagcagcaacatccacacctaccacgtcggaaagcagtgcttctttaatggagtcttcctcggcaacaagaggtctctatcagagaggacggtggacaagtgctttgggagaaagaaatacgatattgatcccaggaatggaatcccaaagttaactccaggcgacaatccatatatgtacccagaacagagtaaaggcttccacaaagcaggatcaatgctcccaccagtgaatttttcaatagtgccttatgaaaagaaatttgatacatttattccacttgagcctcttccacaaattcccaacttgcctttctgggtgaaggagaaggccaacagtttgaaaaatgagatacaagaggttgaggagcttgacaactggcagccagcagtgcccttaatgcacatgctacacctttctggtgctttggactttccaagacaatcctgagcataaacaggcccacaaaacatgtgctgactgcactctggcgacccttttccagttgatgttttttgtcatgtgactgttctaaatccagtgtttgaccctta

SEQ ID NO: 185736 - DNA, 1254 bp, Homo sapiens
  Payload ID: 16576
  Gene Symbol: SPATS1
  Gene Name: spermatogenesis associated, serine-rich 1
  ENST ID: ENST00000506468
  CDS Start-End: 157-372
caggtggagggagtaaggctcccgtttagaggccagtcctgccctcctgactttcggtggcttgtggaatttgtttgttttgactgatacctttcttacgagggactttctttgtctctgggttgcttctaatatttaaaatcatcatgggcacagatgagtccatccatgctcactggaaacagtccacggggctgccgtctcccctccatctcaagcacgacctgcggcagacagctggagaaggttccagaaaaaagggactctggcatgaccgaggtggagaggacctacaagagcaccaccaaagcagagagtctcataaattacctcactggatctcacagcagtggagaagtatattacctatgagtaaagggagccagagatttgacctgcccagtgcttgggttaataaaagggatgttttgccaacacaacaccctctggcaaaagtgtcagttcctcatcttctgtggaaacaggcccaagtgtcagtgagcctcctggcctccccagagtgtctgcttacgtagacaccactgctgacttggatcggaaactctccttctcacattctgatcactcctctgaaatgtcgttgcctgaagtccaaaaggataaatatcctgaggaattcagcctgcttaagttgcagacgaaagatgggcatcgtcctgagtggacattttacccaaggtttagcagcaacatccacacctaccacgtcggaaagcagtgcttctttaatggagtcttcctcggcaacaagaggtctctatcagagaggacggtggacaagtgctttgggagaaagaaatacgatattgatcccaggaatggaatcccaaagttaactccaggcgacaatccatatatgtacccagaacagagtaaaggcttccacaaagcaggatcaatgctcccaccagtgaatttttcaatagtgccttatgaaaagaaatttgatacatttattccacttgagcctcttccacaaattcccaacttgcctttctgggtgaaggagaaggccaacagtttgaaaaatgagatacaagaggttgaggagcttgacaactggcagccagcagtgcccttaatgcacatgctacacctttctggtgctttggactttccaagacaatcctgagcataaacaggcccacaaaacatgtgctgactgcactctggcgacccttttccagttgatgttttttgtcatgtgactgttctaaatccagtgtttgaccc

SEQ ID NO: 185737 - DNA, 1107 bp, Homo sapiens
  Payload ID: 16576
  Gene Symbol: SPATS1
  Gene Name: spermatogenesis associated, serine-rich 1
  Uniprot ID: Q496A3
  ENST ID: ENST00000323108
  CDS Start-End: 102-1004
tctgtgggagaagcaggcggctgcggtgtcccttttgccctaggctctcggttctcaggcctcggcgtgcggcgtgcgttcggcagttcagttgccagttgatgagtccatccatgctcactggaaacagtccacggggctgccgtctcccctccatctcaagcacgacctgcggcagacagctggagaaggttccagaaaaaagggactctggcatgaccgaggtggagaggacctacagtgctaattgcagtgattttctggaatctaagggatgttttgccaacacaacaccctctggcaaaagtgtcagttcctcatcttctgtggaaacaggcccaagtgtcagtgagcctcctggcctccccagagtgtctgcttacgtagacaccactgctgacttggatcggaaactctccttctcacattctgatcactcctctgaaatgtcgttgcctgaagtccaaaaggataaatatcctgaggaattcagcctgcttaagttgcagacgaaagatgggcatcgtcctgagtggacattttacccaaggtttagcagcaacatccacacctaccacgtcggaaagcagtgcttctttaatggagtcttcctcggcaacaagaggtctctatcagagaggacggtggacaagtgctttgggagaaagaaatacgatattgatcccaggaatggaatcccaaagttaactccaggcgacaatccatatatgtacccagaacagagtaaaggcttccacaaagcaggatcaatgctcccaccagtgaatttttcaatagtgccttatgaaaagaaatttgatacatttattccacttgagcctcttccacaaattcccaacttgcctttctgggtgaaggagaaggccaacagtttgaaaaatgagatacaagaggttgaggagcttgacaactggcagccagcagtgcccttaatgcacatgctacacctttctggtgctttggactttccaagacaatcctgagcataaacaggcccacaaaacatgtgctgactgcactctggcgacccttttccagttgatgttttttgtcatgtgactgttctaaatccagtgtttgaccctt

SEQ ID NO: 185738 - DNA, 3158 bp, Homo sapiens
  Payload ID: 16577
  Gene Symbol: SPATS2
  Gene Name: spermatogenesis associated, serine-rich 2
  Uniprot ID: Q86XZ4
  ENST ID: ENST00000321898
  CDS Start-End: 357-1994
gtggctctagaaggggaggtggaggatctcctttcctcttctcagacccgggagcgtccgggacgcggagcccggagctggggcgacgaggcgattgcgggggcctgggctagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaatagatgccagagaattggaggatcccgagtctgccatgctagatacgctggatagaacaggatccatgctgcagaatggtgtctctgattttgagaccaagtctttgactatgcactctattcacaattctcaacaacccaggaatgctgccaaatctctctcaagacctaccacagaaactcagttttcaaatatggggatggaagatgttcccctcgccaccagtaaaaagctaagttccaatattgaaaaatctgtaaaagacctccagcgctgcacagtgtctcttgcacggtatcgagttgtagttaaagaagagatggatgcctccattaagaaaatgaaacaagcctttgctgaattggagagctgtttaatggatcgagaagtggcgttgcttgctgaaatggacaaagtgaaagctgaagcaatggaaattttgctcagccgacaaaagaaggctgaacttctaaagaagatgactcatgtggctgttcaaatgtcagagcagcaattggttgagctcagagctgatatcaagcactttgttagtgaacgtaaatatgatgaggatctgggacgagtagcccggttcacctgtgatgtagagaccctaaagaagagcattgattcatttggacaagtgtctcatccaaagaacagctattcgaccagatcccgatgtagctcagttacatctgtgtccttgagtagcccaagtgatgcctctgctgcttcctcttccacctgtgcctctcctcccagccttacaagtgctaacaagaaaaactttgcaccgggagagactcctgcagccatagcaaactccagtggccagccctaccagccacttcgggaggtattgccagggaacagacgaggaggacagggctataggccacaaggccaaaagtccaatgaccccatgaaccaagggcggcatgacagtatgggtcgttacagaaacagctcgtggtattcatctggttccaggtatcagagtgctccatctcaggcaccaggaaacaccattgaaagaggccagactcactctgcagggaccaatggaactggagtcagcatggagcccagccctcccacgccttcattcaaaaaggggctcccccagcgcaaacccaggacctctcagactgaagccgtgaactcttgagagaaaatccagttggcctctctcctctatccacacaattcaacttgataactggactttaggaaacttacagttagatgtaataacaaaaagaagtttatgcgtatcactttttgtgccattctaagtatttttggtttcttgtctccttatttcctctttaccatttttggaggggaagctattttttttccttgatctttcccagtgatatggattgaatctggttggtcatttccaccaggaatcagaggcagctgttaccaggtttcggccttccagttgatccctccactgtccaggctgtctcaggaggaggtgaatcagagctagtctgtcacctttccaatctaagccgaagccacaggtgcctgacaggttcccttctaacaactatttgaccaagagaggcaatcagggggttgtatactgcactggattcgccagagaagggaaaatttaattagtgaaaaggaaagaacactaggaaacatttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtgaaaccctgtctgtactaaaaatacaaaaattagctgagcatggtggcgtgtgcctgtaatctcagctactcaggaggctgaggcaggagaatcgcttgaacccaggaggcggaggctgcagtgagctgagattgtgccactgcactccagcctgggagacagagcaagactcagtctcaaaaaaaaaaaaaaaagcatttttctgttttaatgtttggagacttttttttttgttctctccctttcctgaaccctattctgatcctgaaccaaatttatagcaatataattagtgttaatctaaggcattactcatcaaaaaaattgctgcagtctttacagttgaataaataaaaacaactgcataaata

SEQ ID NO: 185739 - DNA, 643 bp, Homo sapiens
  Payload ID: 16577
  Gene Symbol: SPATS2
  Gene Name: spermatogenesis associated, serine-rich 2
  ENST ID: ENST00000549298
  CDS Start-End: 535-643
gcccaggagagaagtggggaggcggcggtgggggcggggcggcgtccggctctgagagagctgggggaggagcgcggcggcgacggcggcggtggctctagaaggggaggtggaggatctcctttcctcttctcagacccgggagcgtccgggacgcggagcccggagctggggcgacgaggcgattgcgggggcctgggctagttatttgcagtgacttaaaatttggaggcaaattttccttaagaggatatcaagttccagtatcttcagatgttgataagccgttagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaaggtaa

SEQ ID NO: 185740 - DNA, 546 bp, Homo sapiens
  Payload ID: 16577
  Gene Symbol: SPATS2
  Gene Name: spermatogenesis associated, serine-rich 2
  ENST ID: ENST00000548654
  CDS Start-End: 522-546
aaccgatgccgccgggtacgagctgtgctgcacgcggacgcgagctcgcgtcccacccgttttccccttccatctactttgtccccaaccctctccccgagtctcttcctttccccgctgaggtcactagtgaactctgcttccaagtactcctgcaaagtacaccacaagcctgtctatattctcaagccatccgcttcagttcatatgaccacacttgcatgtcagcaacagaagagaacacacatcatacagcatttacagcagtggacaaagagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaagg

SEQ ID NO: 185741 - DNA, 570 bp, Homo sapiens
  Payload ID: 16577
  Gene Symbol: SPATS2
  Gene Name: spermatogenesis associated, serine-rich 2
  ENST ID: ENST00000549538
  CDS Start-End: 371-570
tccgtcagttcagctcgggccctccgttcccggcgcgcgccgggtccctaaccgatgccgccggctgctggctaccaatattctactttctgtctctatgaatgtgactaccctggttacctcatataatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtaca

SEQ ID NO: 185742 - DNA, 527 bp, Homo sapiens
  Payload ID: 16577
  Gene Symbol: SPATS2
  Gene Name: spermatogenesis associated, serine-rich 2
  ENST ID: ENST00000550643
  CDS Start-End: 424-527
aaccgatgccgccgggtacgagctgtgctgcacgcggacgcgagctcgcgtcccacccgttttccccttccatctactttgtccccaaccctctccccgagtctcttcctttccccgctgctggctaccaatattctactttctgtctctatgaatgtgactaccctggttacctcatataatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaa

SEQ ID NO: 185743 - DNA, 2993 bp, Homo sapiens
  Payload ID: 16577
  Gene Symbol: SPATS2
  Gene Name: spermatogenesis associated, serine-rich 2
  Uniprot ID: Q86XZ4
  ENST ID: ENST00000552918
  CDS Start-End: 385-2022
ctcttctcagacccgggagcgtccgggacgcggagcccggagctggggcgacgaggcgattgcgggggcctgggctagctgctggctaccaatattctactttctgtctctatgaatgtgactaccctggttacctcatataatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaatagatgccagagaattggaggatcccgagtctgccatgctagatacgctggatagaacaggatccatgctgcagaatggtgtctctgattttgagaccaagtctttgactatgcactctattcacaattctcaacaacccaggaatgctgccaaatctctctcaagacctaccacagaaactcagttttcaaatatggggatggaagatgttcccctcgccaccagtaaaaagctaagttccaatattgaaaaatctgtaaaagacctccagcgctgcacagtgtctcttgcacggtatcgagttgtagttaaagaagagatggatgcctccattaagaaaatgaaacaagcctttgctgaattggagagctgtttaatggatcgagaagtggcgttgcttgctgaaatggacaaagtgaaagctgaagcaatggaaattttgctcagccgacaaaagaaggctgaacttctaaagaagatgactcatgtggctgttcaaatgtcagagcagcaattggttgagctcagagctgatatcaagcactttgttagtgaacgtaaatatgatgaggatctgggacgagtagcccggttcacctgtgatgtagagaccctaaagaagagcattgattcatttggacaagtgtctcatccaaagaacagctattcgaccagatcccgatgtagctcagttacatctgtgtccttgagtagcccaagtgatgcctctgctgcttcctcttccacctgtgcctctcctcccagccttacaagtgctaacaagaaaaactttgcaccgggagagactcctgcagccatagcaaactccagtggccagccctaccagccacttcgggaggtattgccagggaacagacgaggaggacagggctataggccacaaggccaaaagtccaatgaccccatgaaccaagggcggcatgacagtatgggtcgttacagaaacagctcgtggtattcatctggttccaggtatcagagtgctccatctcaggcaccaggaaacaccattgaaagaggccagactcactctgcagggaccaatggaactggagtcagcatggagcccagccctcccacgccttcattcaaaaaggggctcccccagcgcaaacccaggacctctcagactgaagccgtgaactcttgagagaaaatccagttggcctctctcctctatccacacaattcaacttgataactggactttaggaaacttacagttagatgtaataacaaaaagaagtttatgcgtatcactttttgtgccattctaagtatttttggtttcttgtctccttatttcctctttaccatttttggaggggaagctattttttttccttgatctttcccagtgatatggattgaatctggttggtcatttccaccaggaatcagaggcagctgttaccaggtttcggccttccagttgatccctccactgtccaggctgtctcaggaggaggtgaatcagagctagtctgtcacctttccaatctaagccgaagccacaggtgcctgacaggttcccttctaacaactatttgaccaagagaggcaatcagggggttgtatactgcactggattcgccagagaagggaaaatttaattagtgaaaaggaaagaacactaggaaacatttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtgaaaccctgtctgtactaaaaatacaaaaattagctgagcatggtggcgtgtgcctgtaatctcagctactcaggaggctgaggcaggagaatcgcttgaacccaggaggcggaggctgcagtgagctgagattgtgccactgcactccagcctgggagacagagcaagactcagtctc

SEQ ID NO: 185744 - DNA, 465 bp, Homo sapiens
  Payload ID: 16577
  Gene Symbol: SPATS2
  Gene Name: spermatogenesis associated, serine-rich 2
  ENST ID: ENST00000552171
  CDS Start-End: 435-465
cggagctggggcgacgaggcgattgcgggggcctgggctagctgctggctaccaatattctactttctgtctctatgaatgtgactaccctggttacctcatatttatttgcagtgacttaaaatttggaggcaaattttccttaagaggatatcaagttccagtatcttcagatgttgataagccgttagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcat

SEQ ID NO: 185745 - DNA, 3320 bp, Homo sapiens
  Payload ID: 16577
  Gene Symbol: SPATS2
  Gene Name: spermatogenesis associated, serine-rich 2
  Uniprot ID: Q86XZ4
  ENST ID: ENST00000553127
  CDS Start-End: 514-2151
gacggcggcggtggctctagaaggggaggtggaggatctcctttcctcttctcagacccgggagcgtccgggacgcggagcccggagctggggcgacgaggcgattgcgggggcctgggctagctgctggctaccaatattctactttctgtctctatgaatgtgactaccctggttacctcatatggaataaggagggagactgatttggaaacatctgtgaggagcaaagaggacacttactcacccccaggtccagtggtatgagagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaatagatgccagagaattggaggatcccgagtctgccatgctagatacgctggatagaacaggatccatgctgcagaatggtgtctctgattttgagaccaagtctttgactatgcactctattcacaattctcaacaacccaggaatgctgccaaatctctctcaagacctaccacagaaactcagttttcaaatatggggatggaagatgttcccctcgccaccagtaaaaagctaagttccaatattgaaaaatctgtaaaagacctccagcgctgcacagtgtctcttgcacggtatcgagttgtagttaaagaagagatggatgcctccattaagaaaatgaaacaagcctttgctgaattggagagctgtttaatggatcgagaagtggcgttgcttgctgaaatggacaaagtgaaagctgaagcaatggaaattttgctcagccgacaaaagaaggctgaacttctaaagaagatgactcatgtggctgttcaaatgtcagagcagcaattggttgagctcagagctgatatcaagcactttgttagtgaacgtaaatatgatgaggatctgggacgagtagcccggttcacctgtgatgtagagaccctaaagaagagcattgattcatttggacaagtgtctcatccaaagaacagctattcgaccagatcccgatgtagctcagttacatctgtgtccttgagtagcccaagtgatgcctctgctgcttcctcttccacctgtgcctctcctcccagccttacaagtgctaacaagaaaaactttgcaccgggagagactcctgcagccatagcaaactccagtggccagccctaccagccacttcgggaggtattgccagggaacagacgaggaggacagggctataggccacaaggccaaaagtccaatgaccccatgaaccaagggcggcatgacagtatgggtcgttacagaaacagctcgtggtattcatctggttccaggtatcagagtgctccatctcaggcaccaggaaacaccattgaaagaggccagactcactctgcagggaccaatggaactggagtcagcatggagcccagccctcccacgccttcattcaaaaaggggctcccccagcgcaaacccaggacctctcagactgaagccgtgaactcttgagagaaaatccagttggcctctctcctctatccacacaattcaacttgataactggactttaggaaacttacagttagatgtaataacaaaaagaagtttatgcgtatcactttttgtgccattctaagtatttttggtttcttgtctccttatttcctctttaccatttttggaggggaagctattttttttccttgatctttcccagtgatatggattgaatctggttggtcatttccaccaggaatcagaggcagctgttaccaggtttcggccttccagttgatccctccactgtccaggctgtctcaggaggaggtgaatcagagctagtctgtcacctttccaatctaagccgaagccacaggtgcctgacaggttcccttctaacaactatttgaccaagagaggcaatcagggggttgtatactgcactggattcgccagagaagggaaaatttaattagtgaaaaggaaagaacactaggaaacatttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtgaaaccctgtctgtactaaaaatacaaaaattagctgagcatggtggcgtgtgcctgtaatctcagctactcaggaggctgaggcaggagaatcgcttgaacccaggaggcggaggctgcagtgagctgagattgtgccactgcactccagcctgggagacagagcaagactcagtctcaaaaaaaaaaaaaaaagcatttttctgttttaatgtttggagacttttttttttgttctctccctttcctgaaccctattctgatcctgaaccaaatttatagcaatataattagtgttaatctaaggcattactcatcaaaaaaattgctgcagtctttacagttgaataaataaaaacaactgcataaatatgccc

SEQ ID NO: 185746 - DNA, 2781 bp, Homo sapiens
  Payload ID: 16577
  Gene Symbol: SPATS2
  Gene Name: spermatogenesis associated, serine-rich 2
  ENST ID: ENST00000549412
  CDS Start-End: 990-1877
aaccgatgccgccgggtacgagctgtgctgcacgcggacgcgagctcgcgtcccacccgttttccccttccatctactttgtccccaaccctctccccgagtctcttcctttccccggtaattcccagtctccggtggcgcgcgagcctgcggacggtgcgagacgcgagggaccgggccccgagaagagcggtaacccgactggtcggagcccgcctctcgccgccccgcgcctctccccgatcttctcggtctccggtgcgcgggccgtctcgccgctcgagccgcgctcgcgcacccgttggctgccacagcctcgagcttggcgcgccggattcgcgccggcgcgagtacgcgccctgagctctggctggctggctggcgcgcacgcgcccgagagggctccggggcggggcgagccgctgcctgggcgagggtcggggtgatctgctggatctccggcagcatcctgcagtccggcccaggagagaagtggggaggcggcggtgggggcggggcggcgtccggctctgagagagctgggggaggagcgcggcggcgacggcggcggtggctctagaaggggaggtggaggatctcctttcctcttctcagacccgggagcgtccgggacgcggagcccggagctggggcgacgaggcgattgcgggggcctgggctagctgctggctaccaatattctactttctgtctctatgaatgtgactaccctggttacctcatataatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaatagatgccagagaattggaggatcccgagtctgccatgctagatacgctggatagaacaggatccatgctgcagaatggtgtctctgattttgagaccaagtctttgactatgcactctattcacaattctcaacaacccaggaatgctgccaaatctctctcaagacctaccacagaaactcagttttcaaatatggggatggaagatgttcccctcgccaccagtaaaaagctaagttccaatattgaaaaatctgtaaaagacctccagcgctgcacagtgtctcttgcacggtatcgagttgtagttaaagaagagatggatgcctccattaagaaaatgaaacaagcctttgctgaattggagagctggtattccaatgctgctagagttcttggagcaaaatattgccaagtttaatggatcgagaagtggcgttgcttgctgaaatggacaaagtgaaagctgaagcaatggaaattttgctcagccgacaaaagaaggctgaacttctaaagaagatgactcatgtggctgttcaaatgtcagagcagcaattggttgagctcagagctgatatcaagcactttgttagtgaacgtaaatatgatgaggatctgggacgagtagcccggttcacctgtgatgtagagaccctaaagaagagcattgattcatttggacaagtgtctcatccaaagaacagctattcgaccagatcccgatgtagctcagttacatctgtgtccttgagtagcccaagtgatgcctctgctgcttcctcttccacctgtgcctctcctcccagccttacaagtgctaacaagaaaaactttgcaccgggagagactcctgcagccatagcaaactccagtggccagccctaccagccacttcgggaggtattgccagggaacagacgaggaggacagggctataggccacaaggccaaaagtccaatgaccccatgaaccaagggcggcatgacagtatgggtcgttacagaaacagctcgtggtattcatctggttccaggtatcagagtgctccatctcaggcaccaggaaacaccattgaaagaggccagactcactctgcagggaccaatggaactggagtcagcatggagcccagccctcccacgccttcattcaaaaaggggctcccccagcgcaaacccaggacctctcagactgaagccgtgaactcttgagagaaaatccagttggcctctctcctctatccacacaattcaacttgataactggactttaggaaacttacagttagatgtaataacaaaaagaagtttatgcgtatcac

SEQ ID NO: 185747 - DNA, 720 bp, Homo sapiens
  Payload ID: 16577
  Gene Symbol: SPATS2
  Gene Name: spermatogenesis associated, serine-rich 2
  ENST ID: ENST00000551540
  CDS Start-End: 497-720
gaggatctcctttcctcttctcagacccgggagcgtccgggacgcggagcccggagctggggcgacgaggcgattgcgggggcctgggctagctgaggtcactagtgaactctgcttccaagtactcctgcaaagtacaccacaagcctgtctatattctcaagccatccgcttcagttcatatgaccacacttgcatgtcagcaacagaagagaacacacatcatacagcatttacagcagtggacaaagagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccag

SEQ ID NO: 185748 - DNA, 558 bp, Homo sapiens
  Payload ID: 16577
  Gene Symbol: SPATS2
  Gene Name: spermatogenesis associated, serine-rich 2
  ENST ID: ENST00000548710
  CDS Start-End: 357-558
gatgccgccgggtacgagctgtgctgcacgcggacgcgagctcgcgtcccacccgttttccccttccatctactttgtccccaaccctctccccgagtctcttcctttccccgaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaag

SEQ ID NO: 185749 - DNA, 675 bp, Homo sapiens
  Payload ID: 16577
  Gene Symbol: SPATS2
  Gene Name: spermatogenesis associated, serine-rich 2
  ENST ID: ENST00000550997
  CDS Start-End: 381-675
gcgctctctcaggaggcagagcgaccgcgcggtccggaggccccagcgtttcccgtcgttggcgactctgaaattgccttttggaacaaaacttgggtcgggaaggaggcgaaggggaaagcggtgtgaagtcctcgaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctg

SEQ ID NO: 185750 - DNA, 701 bp, Homo sapiens
  Payload ID: 16577
  Gene Symbol: SPATS2
  Gene Name: spermatogenesis associated, serine-rich 2
  ENST ID: ENST00000549045
  CDS Start-End: 135-326
caggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaaggctggagtgcagtggcgtgatctcagctcactgcacacctccgcctcccgggttcaagtgattctcctgcctcaacctcccgtgtagctggggatacagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaata

SEQ ID NO: 185751 - DNA, 552 bp, Homo sapiens
  Payload ID: 16577
  Gene Symbol: SPATS2
  Gene Name: spermatogenesis associated, serine-rich 2
  ENST ID: ENST00000548377
  CDS Start-End: 528-552
cgttttccccttccatctactttgtccccaaccctctccccgagtctcttcctttccccgacccgggagcgtccgggacgcggagcccggagctggggcgacgaggcgattgcgggggcctgggctagctgctggctaccaatattctactttctgtctctatgaatgtgactaccctggttacctcatatagatggagtctcactatggtgcctactctgattttgaactcctggcttcaagcaatcctcccaccttggccttccaaagtgctgggattacagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaagg

SEQ ID NO: 185752 - DNA, 1810 bp, Homo sapiens
  Payload ID: 16577
  Gene Symbol: SPATS2
  Gene Name: spermatogenesis associated, serine-rich 2
  ENST ID: ENST00000547865
  CDS Start-End: 435-662
cggagctggggcgacgaggcgattgcgggggcctgggctagctgctggctaccaatattctactttctgtctctatgaatgtgactaccctggttacctcatatttatttgcagtgacttaaaatttggaggcaaattttccttaagaggatatcaagttccagtatcttcagatgttgataagccgttagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaagggaaggagagcgcgagtgaacaaggaaggaactggagggcatgagtgctggaaccggctggctgcttcagtaccagcaggggtgaactctgtgtgggccccgtggcagcatccaggctgtggggtgcctgtgacccccgaagctccagagggcatgttacagtgctcttctggctctgccatttgtggacggcttaagtgttaacagctcagtgggccctttccccccgtgtgtggggtggctgccctctgccagcaagggcaaagggccagtgtgacagccttttgtatctgcactcgtggctcctgagctcttgtctggtgtccaggaaaaatgaggtcacacgaatgaattgaaggatggtaaatgcgggagattttattgctgatgaaagtggcttttagcaggaaggggagctgaaaaggggttggtggggtgcgggtagataatctttccctgaagtccagctgtctccagctagttttttctccaaagttacaccatcaagctgtccctctaaagtcaacccacttctctccgacatcctgacgtccagctagttctcctctctgccagctgagtctggggtctttataggcacagaatggggcagggtggggccatgggtggtttaggaaaaggcaacaaacaggaaaacagagatataagttctcacattgggccaaggtttcaggcattttggcttgagggtggcgttttaaccggtgacccacccttttctgcctagaatttctctgcctcctgtccccatcagttgcttttttctaattactataaaatgaatttaaatattaactataaaagaatttaaattttagactacaacataggccgggtctggtggctcacgcctataatcccagcactttgggaggccgaggtgggtgggtcacaaggtcaggagattgagaccatgctggctaacacagtgaaaccccgtctctactaaaaatacaaaaaaaaaaaaaattagccgggcgtggtggcgggtgcctgtagtcccagctactcaggaggctgaggcaggagaatggtgtgaacccaggaggcggagcttgcagtgagcagagatcatgccactgcactccagcctgggcaacagagagagactctgtctcaaaaaaaaaaaaaaaaaaaatagactacaacatagacactaagtgcttaccagttttggttgaacttagcctagatttacacttagttggaaacaaagtaaagcttatgtgttgttgggactttctctgaaacaaatctatgcatgtaattcatttgcatgtctgatatttggtcccatgacatataaaatattacaacatttcatttattca

SEQ ID NO: 185753 - DNA, 570 bp, Homo sapiens
  Payload ID: 16577
  Gene Symbol: SPATS2
  Gene Name: spermatogenesis associated, serine-rich 2
  ENST ID: ENST00000549179
  CDS Start-End: 555-570
gtgctgcacgcggacgcgagctcgcgtcccacccgttttccccttccatctactttgtccccaaccctctccccgagtctcttcctttccccgacccgggagcgtccgggacgcggagcccggagctggggcgacgaggcgattgcgggggcctgggctagctgctggctaccaatattctactttctgtctctatgaatgtgactaccctggttacctcatatttatttgcagtgacttaaaatttggaggcaaattttccttaagaggatatcaagttccagtatcttcagatgttgataagccgttagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacaga

SEQ ID NO: 185754 - DNA, 505 bp, Homo sapiens
  Payload ID: 16577
  Gene Symbol: SPATS2
  Gene Name: spermatogenesis associated, serine-rich 2
  ENST ID: ENST00000548777
  CDS Start-End: 407-505
agacccgggagcgtccgggacgcggagcccggagctggggcgacgaggcgattgcgggggcctgggctagagatggagtctcactatggtgcctactctgattttgaactcctggcttcaagcaatcctcccaccttggccttccaaagtgctgggattacagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaa

SEQ ID NO: 185755 - DNA, 6156 bp, Homo sapiens
  Payload ID: 16578
  Gene Symbol: SPATS2L
  Gene Name: spermatogenesis associated, serine-rich 2-like
  Uniprot ID: Q9NUQ6
  ENST ID: ENST00000358677
  CDS Start-End: 248-1924
gcagaaacccacggctgaagcccacgatgcccatgtgtaacttggttattacacacacgtttggagcccagtgtgcagacccgcagcgcagaggaggcggcggaacaccccgggttggtcgggtttccaagggctgacccgagctccagcactttttccgcgcctgatttttcagagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttgacacctggctagtttcttttattgatacccacctagttattgaatgtactgtttagtgctttcaaaaaaaactttagagactagaggttgtggtgcaaagctgtgtacaataaatactgtttctgttgagacaagtactctttcaggaaaatatatatatgccctttcaattagattacacaaatagatggatatgcaccctgatcatcttagacacaccatgtggcagttgggcagttggaaacattggttgcaagtactacaaacctcagctgagcctagcttcaacaataagaatttattggttcagtgagtgaaaagtccagttggtccaatttgatcaggatttcagctcccatctcttttttttttttcttttttctttttctttttttgagacagtcttgctttgtcacccaggtggagtgcaatggcatgatctcggctcactgcaacctccgcctcctgggttcaagccattctcctgcccggccttccgagtagctgggattacaggcatgtgccaccacgccctgctaatttttatattattagtacagacaggatttcaccatgttgtccaggctggtctcaaacccctgacctcaggtgatccacctgctttggcctccgaaactgccggaattacaggcatgagccaccgtacccggccagctcccatctcttaattatcttagctctcctttcctccttgggttgacattgcattcagaattgtggcaaagggccaccatgctcttaagactcaagtctattttccacactgtccagaggagagaagttatcctagtagcttctacacagagcaagtgtctttctcagaaatcccagcaaaggtcttgcataccattgctggtaggcctgtctcttaaaccaatcatgaaaggggggagagaagtgaatgggatgaactaatttgcatagactaattagagcccacccctggagcctgggtgtggccatcttcccagagttcctgagctagatggagaaggggtacttctcagaaagggaaaatggatacccaatggcccaaacccaaaatagccccagttcccctaactttgactacagggcagtccagtttgggtgccgcttccgttgcactcacatgtcctacatatctgttgactactcacaagtgcaaatgcttattctcaactcaacattaacattttttctggcaacccaggttcactggttctcttccacagagcggccctgagcagctgagcctgcaagccacgcaagcatctgtttcttcttttgccaagtacaggaggatgtttgctctctctgtagagagctttctgaggtctctgggtgtacccagagatttaatagaaattcttaacgttaagtcacattccaggaaggaaggaagagttgttcgttcaaataagaaagataaatgttcggcactgtaggccctgtttaccccatctgaggccctgaattcatatattacaagacggaaggattttgcacagttttttatgtagcaagattttgctcaccactgaaaaatgtcagtgtaaatgtgaccgctttaaagatgagtcaagtaattcttggaacagggaaaaaaatgaatttgccaggtcaggagttcacctgcctttgtcagagttgaacccaaccactcttgacctcgactcactcccttagggttaagaaagcccaaacacattcctgagcacagagcaaacactcccatgtcactgaaaagaaacaaaagaatgctaaaaagtgctcagacctgatcacattttttccaatattttttcctttttttttttttttttgagacagggtcttgctctatcacctaggctggagtgcatgtttttgagacagggtcttgctctatcacctaggctggagtgcatgatcatggctcactatagccttgaactcctgggctcaagccatcctcagcctcccaagttgcgaggactacaggtgtgcaccacaacgtcccagctactttttaaatttttagtagaaacgaggtctcactatggtgcccagactggtctcgaactccggagctcaagtgatcttcctgctttggcctcccaaagtgttagaattacaggcatgagccacctcgcctggctggtttttgcctttcttatagaccctgggcatgtaagcatttattagtttgcatttttgaaacagtaatttcaatattttagtgccaatgtcaggccgcttaaacactgtattacatatcttcatctgtctggtggaactattggtgtgatcctagagaactgagtcctattctgccattcatttaaagtgttttaaactctaatctctctacttaatgcacagtagtcagattattctcttaaacatttgcctagtagaggttaaaatagtttaatccttatgaagatggaataacttcaaactcacattgtggcacttagatcttccaccaagacttcatccgtgaaatccacacctccctgttgggttcccaattacattccaaatttacatttcttttgagaatctctgcatactccagctctgtcctgttgatcctattctagaagtgcttaatgcagcaagacacagaaagttaaacgcaaattgctgcaaaattcaccctcagtggaggactagaaacacaacatgtccaatttaaagctcagttcacaagcagttcaattctgctggcatcagaaaaggagattctaattaaacattcttagggaaggacatcaaatgaggttaatgggaaacgttaccagattaaaagcagttttttgacaaagtaacagatttggaaattctgactctctgaaagccttgatttgaacctcaaacttgatttcaccatgagaagtggggatcaagggcctgcgcagttcttttcctaaatcgattcggtgctccccaccccgacgcaggcacaggtccgcaaccagatagggagatgcctgaatttcaggctacctttgacaaagctttcttcctccctccctccctttgcacgctgcatcccacgctgcctgcttaaagcgccctcatgtgtctacagatggtaaaacgtttatttctcaacagacattccagtgatagcatccaatgacctatgtaacggcacccttttttgctgtacgcgttttttgagatggagtctcgctctgtcgcccaggctggagtgcagtggcgcggtctcggctcactgcaagctccgcctcccgggttcacgccattctcctgcctcagcctcccgagtagctgggactacaggcacccgccaccacacctggctaattttttgtatttttagtagatacagggtttcaccgtgttagccaggatggttttgatctcctgacctcgtgatccacccccctcggcctcccaaagtgctgggattacaggggtgagccactgcgcccggccccagtcacttgttcttaagtttcttaagcaaactataaaatagcaaaagaccaaaaaaaaaggaaaaaaagcagttcgcctaatacattgttccagcatttccttgaaagtactgagccatctcaattgctctgattttgtgagaaaattatgaagagttgcaaagtcccagtgattctcttgttacttagctaagaatttgaaatgtaatttaaatactattctttacaatccattataaggattttaaaatctttttgcttctttaataaattctaacaaag

SEQ ID NO: 185756 - DNA, 2119 bp, Homo sapiens
  Payload ID: 16578
  Gene Symbol: SPATS2L
  Gene Name: spermatogenesis associated, serine-rich 2-like
  Uniprot ID: Q9NUQ6
  ENST ID: ENST00000360760
  CDS Start-End: 151-1620
acaaaacccgagagaggcgtgagcagcgctgtgtttgcgagcgggagcgaggggcgccggctggggtgtgtgctcctgagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 185757 - DNA, 1979 bp, Homo sapiens
  Payload ID: 16578
  Gene Symbol: SPATS2L
  Gene Name: spermatogenesis associated, serine-rich 2-like
  Uniprot ID: Q9NUQ6
  ENST ID: ENST00000409151
  CDS Start-End: 101-1801
tttcttctgtagctgagcacttgctgggagggagtgccaaacatctcagtgtttgtgtttttagatgcactaaccaacaatagcaagcttttctccaagcatggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcat

SEQ ID NO: 185758 - DNA, 2648 bp, Homo sapiens
  Payload ID: 16578
  Gene Symbol: SPATS2L
  Gene Name: spermatogenesis associated, serine-rich 2-like
  Uniprot ID: Q9NUQ6
  ENST ID: ENST00000409718
  CDS Start-End: 473-2149
actgcctctggaagaagagtgttatctaaagtgcttccatcatgaataatgattgagaaactgcttttactctcccgactactgtactcccaggcagaaacccacggctgaagcccacgatgcccatgtgtaacttggttattacacacacgtttggagcccagtgtgcagacccgcagcgcagaggaggcggcggaacaccccgggttggtcgggtttccaagggctgacccgagctccagcactttttccgcgcctgatttttcaggtcattttcgaatgggctatctttgcttacattttgagcttggatcctctccagaaagcattactaccttctaaaaggaaaaacatctcgtatttgcagacagtgctgagggagcaaagttcattttctcggagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 185759 - DNA, 2320 bp, Homo sapiens
  Payload ID: 16578
  Gene Symbol: SPATS2L
  Gene Name: spermatogenesis associated, serine-rich 2-like
  ENST ID: ENST00000409385
  CDS Start-End: 326-1822
aggtcattttcgaatgggctatctttgcttacattttgagcttggatcctctccagaaagcattactaccttctaaaaggaaaaacatctcgtatttgcagacagtgctgagggagcaaagttcattttctcggagctcttcagaaaccaggctgctttcaggaacattgctgtggattcccagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttg

SEQ ID NO: 185760 - DNA, 920 bp, Homo sapiens
  Payload ID: 16578
  Gene Symbol: SPATS2L
  Gene Name: spermatogenesis associated, serine-rich 2-like
  ENST ID: ENST00000409397
  CDS Start-End: 124-920
cccgggccccggctccggcccgggacggaggagccggcgctcgacacagagagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgc

SEQ ID NO: 185761 - DNA, 2463 bp, Homo sapiens
  Payload ID: 16578
  Gene Symbol: SPATS2L
  Gene Name: spermatogenesis associated, serine-rich 2-like
  Uniprot ID: Q9NUQ6
  ENST ID: ENST00000409140
  CDS Start-End: 288-1964
ggaatccagtccgggggccgagctggctgcgccctccgctgcaagcgccggcagcgcggggcgagctccggacggcgcgcggcccaggcagcggctcccgctcggcccgccctccgagccgcaggggccgccaccgccgcggcgcctcccctggcgaccgcgcccccgggccccggctccggcccgggacggaggagccggcgctcgacacagagagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 185762 - DNA, 2698 bp, Homo sapiens
  Payload ID: 16578
  Gene Symbol: SPATS2L
  Gene Name: spermatogenesis associated, serine-rich 2-like
  Uniprot ID: Q9NUQ6
  ENST ID: ENST00000409988
  CDS Start-End: 524-2200
gatttttcaggtcattttcgaatgggctatctttgcttacattttgagcttggatcctctccagaaagcattactaccttctaaaaggaaaaacatctcgtatttgcagacagtgctgagggagcaaagttcattttctcgggtaggagaagatgattctcttgcaacacgtgcggattgtgacaaaatctttcattaacaaggggagtttcggtgaagtggaggtttggggaaaggcgaggaagtcggtctggagcaagcaagcaaagtgcggaagctgtactgggattcttctagaaagtggggtgggaaaggagctagggagggcgtgtggagggacgagatctgtgtcagaacgtgcgtgtgagcggatacaaaacccgagagaggcgtgagcagcgctgtgtttgcgagcgggagcgaggggcgccggctggggtgtgtgctcctgagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttg

SEQ ID NO: 185763 - DNA, 2460 bp, Homo sapiens
  Payload ID: 16578
  Gene Symbol: SPATS2L
  Gene Name: spermatogenesis associated, serine-rich 2-like
  ENST ID: ENST00000409755
  CDS Start-End: 535-1962
ggaatccagtccgggggccgagctggctgcgccctccgctgcaagcgccggcagcgcggggcgagctccggacggcgcgcggcccaggcagcggctcccgctcggcccgccctccgagccgcaggggccgccaccgccgcggcgcctcccctggcgaccgcgcccccgggccccggctccggcccgggacggaggagccggcgctcgacacagagagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccccagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttg

SEQ ID NO: 185764 - DNA, 835 bp, Homo sapiens
  Payload ID: 16578
  Gene Symbol: SPATS2L
  Gene Name: spermatogenesis associated, serine-rich 2-like
  ENST ID: ENST00000457757
  CDS Start-End: 272-835
gtgtttgcgagcgggagcgaggggcgccggctggggtgtgtgctcctgagctcttcagaaaccaggctgctttcaggaacattgctgtggattcccagttcaagcaaagtgatgtaatacccaagaacaggaaagtaaacctaagagcattaatgggtttcagagaaacgaaagtgaaactttattactgcctacacaatcaaacaggagggagaaaggagacaagcaagtcagaaagcgatttgatagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagc

SEQ ID NO: 185765 - DNA, 637 bp, Homo sapiens
  Payload ID: 16578
  Gene Symbol: SPATS2L
  Gene Name: spermatogenesis associated, serine-rich 2-like
  ENST ID: ENST00000453663
  CDS Start-End: 57-637
gagcgaggggcgccggctggggtgtgtgctcctgggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactg

SEQ ID NO: 185766 - DNA, 2250 bp, Homo sapiens
  Payload ID: 16578
  Gene Symbol: SPATS2L
  Gene Name: spermatogenesis associated, serine-rich 2-like
  Uniprot ID: Q9NUQ6
  ENST ID: ENST00000451764
  CDS Start-End: 503-2179
tttggggaaaggcgaggaagtcggtctggagcaagcaagcaaagtgcggaagctgtactgggattcttctagaaagtggggtgggaaaggagctagggagggcgtgtggagggacgagatctgtgtcagaacgtgcgtgtgagcggatacaaaacccgagagaggcgtgagcagcgctgtgtttgcgagcgggagcgaggggcgccggctggggtgtgtgctcctgggagccccctaatgaaagtcttcagtaaatagtttttctgcatgcactgattttcctgaggccattgtggagagagttatctgtgggcttgagaagctgctctgccacaccagtaaggatcagggaaagaaaatacttaggccacaccgttgcagtctttgattgcatgccagtctgaagcattttatggacccgttttgccatagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgcc

SEQ ID NO: 185767 - DNA, 771 bp, Homo sapiens
  Payload ID: 16578
  Gene Symbol: SPATS2L
  Gene Name: spermatogenesis associated, serine-rich 2-like
  ENST ID: ENST00000423749
  CDS Start-End: 353-771
tgtgtttgcgagcgggagcgaggggcgccggctggggtgtgtgctcctgagctcttcagaaaccaggctgctttcaggaacattgctgtggattcccaggtgaccaaggccaccaaccccctgctgattactcagccacgcccaagatcctgctactaccctggtttctggctccacattcgtcactattgagatgacttactggtcacagtaaaagcaagttgataaaggtggccagtgggggaacagagcttatgtgcctcctgagaaagccagtcgctggaaactggactgagagccctgatttggagcacgaggaaaccttaaaaaggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaacc

SEQ ID NO: 185768 - DNA, 541 bp, Homo sapiens
  Payload ID: 16578
  Gene Symbol: SPATS2L
  Gene Name: spermatogenesis associated, serine-rich 2-like
  ENST ID: ENST00000428692
  CDS Start-End: 503-541
gtgtttgcgagcgggagcgaggggcgccggctggggtgtgtgctcctgagctcttcagaaaccaggctgctttcaggaacattgctgtggattcccaggtgaccaaggccaccaaccccctgctgattactcagccacgcccaagatcctgctactaccctggtttctggctccacattcgtcactattgagatgacttactggtcacagtaaaagcaagttgataaaggtggccagtgggggaacagagcttatgtgcctcctgagaaagccagtcgctggaaactggactgagagccctgatttggagcacgaggaaaccttaaaaattcaagcaaagtgatgtaatacccaagaacaggaaagtaaacctaagagcattaatgggtttcagagaaacgaaagtgaaactttattactgcctacacaatcaaacaggagggagaaaggagacaagcaagtcagaaagcgatttgatagggcctattccactagaagcaagatggctgaactcaatactcatgtgaatgtcaaggaaaag

SEQ ID NO: 185769 - DNA, 600 bp, Homo sapiens
  Payload ID: 16578
  Gene Symbol: SPATS2L
  Gene Name: spermatogenesis associated, serine-rich 2-like
  ENST ID: ENST00000421573
  CDS Start-End: 138-600
agagctataccttccctaagataagaaggatgaagagctggcattcactaacaggaccctgaaggcaaaaacactgggcagtttcacaaaaagggaacaagtagtctctctgaagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgc

SEQ ID NO: 185770 - DNA, 605 bp, Homo sapiens
  Payload ID: 16578
  Gene Symbol: SPATS2L
  Gene Name: spermatogenesis associated, serine-rich 2-like
  ENST ID: ENST00000444012
  CDS Start-End: 535-605
attttctcgggtaggagaagatgattctcttgcaacacgtgcggattgtgacaaaatctttcattaacaaggggagtttcggtgaagtggaggtttggggaaaggcgaggaagtcggtctggagcaagcaagcaaagtgcggaagctgtactgggattcttctagaaagtggggtgggaaaggagctagggagggcgtgtggagggacgagatctgtgtcagaacgtgcgtgtgagcggatacaaaacccgagagaggcgtgagcagcgctgtgtttgcgagcgggagcgaggggcgccggctggggtgtgtgctcctgagctcttcagaaaccaggctgctttcaggaacattgctgtggattcccagctttcagacaacacatgactaagacagaatgagaccactctagttgcctcatgggaaactcgggaaaagactgcaaaaacaacattgtttctccctttggaattctggagttataaggcagaggtcccccatcttcccgaactggcctattccactagaagcaagatggctgaactcaatactcatgtgaatgtcaaggaaaagatctatgcagttagatcagttgttcccaacaa

SEQ ID NO: 185771 - DNA, 695 bp, Homo sapiens
  Payload ID: 16578
  Gene Symbol: SPATS2L
  Gene Name: spermatogenesis associated, serine-rich 2-like
  ENST ID: ENST00000366118
  CDS Start-End: 1-353
gcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccaagtctcaccctgtcacccaggctggagtgcagtggcacaatctctgctcactgcaagctccacctcccaggttcacaccattctcctgcctcagcctcctgagtagctgggattacaggcgcccaccaccacgcccagctaattttttgggtttttagtagagatggggtttcaccatgttagccaggatggtctcaatctcctgaccttgtgatccgcccagctcagcctcccaaagtgctgggattataggcttgagccaccgcgcccggcctaaacagttttcttaaaatactccagttctgttcatgaacttcgtcaaatacactgacacctgccaacttaaaaccgcaaaagaaaatcaattccatatattaaattgaaaatcacaaatcagattgcttaatgtaccaaattctctgtttaaataatgaacacgctcaaattatcttgatcattgcaaaacttaatcctaaatttaacataaaatattaacattc

SEQ ID NO: 185772 - DNA, 584 bp, Homo sapiens
  Payload ID: 16578
  Gene Symbol: SPATS2L
  Gene Name: spermatogenesis associated, serine-rich 2-like
  ENST ID: ENST00000439084
  CDS Start-End: 303-584
gcatttcactctactgcctctggaagaagagtgttatctaaagtgcttccatcatgaataatgattgagaaactgcttttactctcccgactactgtactcccaggcagaaacccacggctgaagcccacgatgcccatgtgtaacttggttattacacacacgtttggagcccagtgtgcagacccgcagcgcagaggaggcggcggaacaccccgggttggtcgggtttccaagggctgacccgagctccagcactttttccgcgcctgatttttcagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcaggg

SEQ ID NO: 185773 - DNA, 561 bp, Homo sapiens
  Payload ID: 16578
  Gene Symbol: SPATS2L
  Gene Name: spermatogenesis associated, serine-rich 2-like
  ENST ID: ENST00000439395
  CDS Start-End: 216-561
aaagttcattttctcgggtaggagaagatgattctcttgcaacacgtgcggattgtgacaaaatctttcattaacaaggggagtttcggtgaagtggaggtttggggaaaggcgaggaagtcggtctggagcaagcaagcaaaagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagct

SEQ ID NO: 185774 - DNA, 678 bp, Homo sapiens
  Payload ID: 16578
  Gene Symbol: SPATS2L
  Gene Name: spermatogenesis associated, serine-rich 2-like
  ENST ID: ENST00000449647
  CDS Start-End: 158-678
gacttactggtcacagtaaaagcaagttgataaaggtggccagtgggggaacagagcttatgtgcctcctgagaaagccagtcgctggaaactggactgagagccctgatttggagcacgaggaaaccttaaaaaggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaa

SEQ ID NO: 185775 - DNA, 887 bp, Homo sapiens
  Payload ID: 16578
  Gene Symbol: SPATS2L
  Gene Name: spermatogenesis associated, serine-rich 2-like
  ENST ID: ENST00000438761
  CDS Start-End: 174-887
gtgagaatatgtattccccaatttgagaatctgggttgggcgccatggtgctgatcgaggattggcagcccctttcctaatatctgttgagatagaacagctcctaaagttggaccatggaaaggaaaagcactttaaagaatcagactcatagcaattgatccctgcaaaacatggctggtggacagaccaatatgatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggcc

SEQ ID NO: 185776 - DNA, 6115 bp, Homo sapiens
  Payload ID: 16578
  Gene Symbol: SPATS2L
  Gene Name: spermatogenesis associated, serine-rich 2-like
  Uniprot ID: Q9NUQ6
  ENST ID: ENST00000619961
  CDS Start-End: 124-1890
attgtggagagagttatctgtgggcttgagaagctgctctgccacaccagtaaggatcagggaaagaaaatacttaggccacaccgttgcagtctttgattgcatgccagtctgaagcattttatggacccgttttgccatagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttgacacctggctagtttcttttattgatacccacctagttattgaatgtactgtttagtgctttcaaaaaaaactttagagactagaggttgtggtgcaaagctgtgtacaataaatactgtttctgttgagacaagtactctttcaggaaaatatatatatgccctttcaattagattacacaaatagatggatatgcaccctgatcatcttagacacaccatgtggcagttgggcagttggaaacattggttgcaagtactacaaacctcagctgagcctagcttcaacaataagaatttattggttcagtgagtgaaaagtccagttggtccaatttgatcaggatttcagctcccatctcttttttttttttcttttttctttttctttttttgagacagtcttgctttgtcacccaggtggagtgcaatggcatgatctcggctcactgcaacctccgcctcctgggttcaagccattctcctgcccggccttccgagtagctgggattacaggcatgtgccaccacgccctgctaatttttatattattagtacagacaggatttcaccatgttgtccaggctggtctcaaacccctgacctcaggtgatccacctgctttggcctccgaaactgccggaattacaggcatgagccaccgtacccggccagctcccatctcttaattatcttagctctcctttcctccttgggttgacattgcattcagaattgtggcaaagggccaccatgctcttaagactcaagtctattttccacactgtccagaggagagaagttatcctagtagcttctacacagagcaagtgtctttctcagaaatcccagcaaaggtcttgcataccattgctggtaggcctgtctcttaaaccaatcatgaaaggggggagagaagtgaatgggatgaactaatttgcatagactaattagagcccacccctggagcctgggtgtggccatcttcccagagttcctgagctagatggagaaggggtacttctcagaaagggaaaatggatacccaatggcccaaacccaaaatagccccagttcccctaactttgactacagggcagtccagtttgggtgccgcttccgttgcactcacatgtcctacatatctgttgactactcacaagtgcaaatgcttattctcaactcaacattaacattttttctggcaacccaggttcactggttctcttccacagagcggccctgagcagctgagcctgcaagccacgcaagcatctgtttcttcttttgccaagtacaggaggatgtttgctctctctgtagagagctttctgaggtctctgggtgtacccagagatttaatagaaattcttaacgttaagtcacattccaggaaggaaggaagagttgttcgttcaaataagaaagataaatgttcggcactgtaggccctgtttaccccatctgaggccctgaattcatatattacaagacggaaggattttgcacagttttttatgtagcaagattttgctcaccactgaaaaatgtcagtgtaaatgtgaccgctttaaagatgagtcaagtaattcttggaacagggaaaaaaatgaatttgccaggtcaggagttcacctgcctttgtcagagttgaacccaaccactcttgacctcgactcactcccttagggttaagaaagcccaaacacattcctgagcacagagcaaacactcccatgtcactgaaaagaaacaaaagaatgctaaaaagtgctcagacctgatcacattttttccaatattttttcctttttttttttttttttgagacagggtcttgctctatcacctaggctggagtgcatgtttttgagacagggtcttgctctatcacctaggctggagtgcatgatcatggctcactatagccttgaactcctgggctcaagccatcctcagcctcccaagttgcgaggactacaggtgtgcaccacaacgtcccagctactttttaaatttttagtagaaacgaggtctcactatggtgcccagactggtctcgaactccggagctcaagtgatcttcctgctttggcctcccaaagtgttagaattacaggcatgagccacctcgcctggctggtttttgcctttcttatagaccctgggcatgtaagcatttattagtttgcatttttgaaacagtaatttcaatattttagtgccaatgtcaggccgcttaaacactgtattacatatcttcatctgtctggtggaactattggtgtgatcctagagaactgagtcctattctgccattcatttaaagtgttttaaactctaatctctctacttaatgcacagtagtcagattattctcttaaacatttgcctagtagaggttaaaatagtttaatccttatgaagatggaataacttcaaactcacattgtggcacttagatcttccaccaagacttcatccgtgaaatccacacctccctgttgggttcccaattacattccaaatttacatttcttttgagaatctctgcatactccagctctgtcctgttgatcctattctagaagtgcttaatgcagcaagacacagaaagttaaacgcaaattgctgcaaaattcaccctcagtggaggactagaaacacaacatgtccaatttaaagctcagttcacaagcagttcaattctgctggcatcagaaaaggagattctaattaaacattcttagggaaggacatcaaatgaggttaatgggaaacgttaccagattaaaagcagttttttgacaaagtaacagatttggaaattctgactctctgaaagccttgatttgaacctcaaacttgatttcaccatgagaagtggggatcaagggcctgcgcagttcttttcctaaatcgattcggtgctccccaccccgacgcaggcacaggtccgcaaccagatagggagatgcctgaatttcaggctacctttgacaaagctttcttcctccctccctccctttgcacgctgcatcccacgctgcctgcttaaagcgccctcatgtgtctacagatggtaaaacgtttatttctcaacagacattccagtgatagcatccaatgacctatgtaacggcacccttttttgctgtacgcgttttttgagatggagtctcgctctgtcgcccaggctggagtgcagtggcgcggtctcggctcactgcaagctccgcctcccgggttcacgccattctcctgcctcagcctcccgagtagctgggactacaggcacccgccaccacacctggctaattttttgtatttttagtagatacagggtttcaccgtgttagccaggatggttttgatctcctgacctcgtgatccacccccctcggcctcccaaagtgctgggattacaggggtgagccactgcgcccggccccagtcacttgttcttaagtttcttaagcaaactataaaatagcaaaagaccaaaaaaaaaggaaaaaaagcagttcgcctaatacattgttccagcatttccttgaaagtactgagccatctcaattgctctgattttgtgagaaaattatgaagagttgcaaagtcccagtgattctcttgttacttagctaagaatttgaaatgtaatttaaatactattctttacaatccattataaggattttaaaatctttttgcttctttaataaattct

SEQ ID NO: 185777 - DNA, 1868 bp, Homo sapiens
  Payload ID: 16579
  Gene Symbol: SPZ1
  Gene Name: spermatogenic leucine zipper 1
  Uniprot ID: Q9BXG8
  ENST ID: ENST00000296739
  CDS Start-End: 242-1534
aaacaccgggtgcctagaggagaagagatggagccccagccttggtcccctttcccacccttcctccccacaaggctgtctgagatgccaccttccacctaaacatcatctcccaaattttaatccttaactttggtctctgacttctgcttgattccacagtctccacccacatttgcacaaaggaccatcacctgtccttcctggaatctctaaagttttctgctttccttctgtcctgatggccagctctgctaagtcagctgagatgcccaccatctccaaaaccgttaaccctactcctgatcctcatcaagaatatctggaccctaggattaccattgccttattcgaaattggatcacattccccttcctcctggggctctctccctttcctaaagaatagcagccatcaagttacagaacaacagactgcacagaagtttaacaatctcttaaaagaaattaaagatattcttaaaaatatggcaggttttgaagagaagatcacagaagcaaaagaactttttgaggaaaccaatattactgaggatgtgtcagcccacaaagaaaatatcagaggacttgacaaaatcaatgaaatgttatcaacaaacctgcctgttagtttagccccagagaaagaagacaatgaaaagaaacaggagatgatattggaaaccaatattactgaggatgtgtcagcccacaaagaaaatatcagaggacttgacaaaatcaatgaaatgttatcaacaaacctgcctgttagtttagccccagagaaagaagacaatgaaaagaaacagcagatgataatggaaaaccagaactctgagaacaccgcacaagtttttgcaagagatttggtaaatcgtttagaagaaaaaaaagtccttaacgaaactcaacaaagtcaggaaaaagcaaaaaacagacttaatgttcaagaagaaactatgaaaattaggaacaacatggagcagttactacaggaagcagaacactggagtaaacaacatactgagctcagtaaactgataaaatcctatcagaaatctcagaaagacataagtgaaactcttggaaataatggagtcggtttccaaacccagccaaataatgaagtgtcggctaagcatgagctggaggaacaggtgaagaaactgagccatgacacctattcattgcagttgatggcagctttgctagagaatgaatgccaaatcttacagcagagagtagagattctcaaggaactccatcatcagaaacagggaactctgcaagagaagccaattcagataaactataaacaggacaagaaaaatcagaagccatcagaagcaaagaaagtagaaatgtataagcagaacaagcaagcaatgaagggtacattttggaaaaaagacagatcctgtagaagcctggatgtttgtcttaataagaaagcttgcaatacccagttcaatattcatgttgcaagaaaagctcttaggggaaaaatgaggtcagctagcagcctaagatagaaaataccaaaagcagatgaaaaggtgaatccttaaaaaactacatctgttacctccaacttgtcagtcatgatcaatcatcaaaccttgggcagatctgctggttcaaccaagaaagagctatagaataaggagattgacacttatattactcattacttcagcagttatgtaagtctggtctttaatgaccattgtgtctacatcaagttcataacttttcacctttacaatctgcttgttttttttgtaattattagatagacagcctagagtgagaagttaaaggtccaattaagtaaagatctaaataaaaaccagaatacaagggaaa

SEQ ID NO: 185778 - DNA, 859 bp, Homo sapiens
  Payload ID: 16579
  Gene Symbol: SPZ1
  Gene Name: spermatogenic leucine zipper 1
  ENST ID: ENST00000511881
  CDS Start-End: 157-859
atgaaaggatggggacctcaccagagaggactggtctcagcaatgtccttaagtggtcaaaacatgctgcggttgagtctccacccacatttgcacaaaggaccatcacctgtccttcctggaatctctaaagttttctgctttccttctgtcctgatggccagctctgctaagtcagctgagatgcccaccatctccaaaaccgttaaccctactcctgatcctcatcaagaatatctggaccctaggattaccattgccttattcgaaattggatcacattccccttcctcctggggctctctccctttcctaaagaatagcagccatcaagttacagaacaacagactgcacagaagtttaacaatctcttaaaagaaattaaagatattcttaaaaatatggcaggttttgaagagaagatcacagaagcaaaagaactttttgaggaaaccaatattactgaggatgtgtcagcccacaaagaaaatatcagaggacttgacaaaatcaatgaaatgttatcaacaaacctgcctgttagtttagccccagagaaagaagacaatgaaaagaaacaggagatgatattggaaaccaatattactgaggatgtgtcagcccacaaagaaaatatcagaggacttgacaaaatcaatgaaatgttatcaacaaacctgcctgttagtttagccccagagaaagaagacaatgaaaagaaacagcagatgataatggaaaaccagaactctgagaacaccgcacaagtttttgcaagagatttggtaaatcgtttagaagaaaaaaaagtccttaacgaaactcaacaaagtcaggaaaaagcaaaaaacagactta

SEQ ID NO: 185779 - DNA, 1266 bp, Homo sapiens
  Payload ID: 16580
  Gene Symbol: SRM
  Gene Name: spermidine synthase
  Uniprot ID: P19623
  ENST ID: ENST00000376957
  CDS Start-End: 82-990
ggcggagctggtcccgttgtgctgcggcgccgcgcggcctgcagtcccgggcccgcgccccgcgccgcccgcccgcccgccatggagcccggccccgacggccccgccgcctccggccccgccgccatccgcgagggctggttccgcgagacctgcagcctgtggcccggccaggccctgtcactgcaggtggagcagctgctccaccaccggcgctcgcgctaccaggacatcctcgtcttccgcagtaagacctatggcaacgtgctggtgttggacggtgtcatccagtgcacggagagagacgagttctcctaccaggagatgatcgccaacctgcctctctgcagccaccccaacccgcgaaaggtgctgatcatcgggggcggagatggaggtgtcctgcgggaggtggtgaagcacccctccgtggagtccgtggtccagtgtgagatcgacgaggatgtcatccaagtctccaagaagttcctgccaggcatggccattggctactctagctcgaagctgaccctacatgtgggtgacggttttgagttcatgaaacagaatcaggatgccttcgacgtgatcatcactgactcctcagaccccatgggccccgccgaaagtctcttcaaggagtcctattaccagctcatgaagacagccctcaaggaagatggtgtcctctgctgccagggcgagtgccagtggctgcacctggacctcatcaaggagatgcggcagttctgccagtccctgttccccgtggtggcctatgcctactgcaccatccccacctaccccagcggccagatcggcttcatgctgtgcagcaagaacccgagcacgaacttccaggagccggtgcagccgctgacacagcagcaggtggcgcagatgcagctgaagtactacaactccgacgtgcaccgcgccgcctttgtgctgcccgagtttgcccgcaaggccctgaatgatgtgagctgagcccaggcgccaccactgatgccacccaggacctcggaccttggagcctgcggggtgcctcggcccctccagccccgggccggacctcctgctggctctcgcccaccaaccaagtgttacaagccccagaatgctgcccggcctgccctgctgggcggactgtctgtgtgtctgtctctctggcgttccacctccaagcctataccagctgtgtacagcgccatctctctgccttctgttgcccctcactcaccaaacacgtgtatttatagcaaa

SEQ ID NO: 185780 - DNA, 731 bp, Homo sapiens
  Payload ID: 16580
  Gene Symbol: SRM
  Gene Name: spermidine synthase
  ENST ID: ENST00000459997
  CDS Start-End: 78-359
gagctggtcccgttgtgctgcggcgccgcgcggcctgcagtcccgggcccgcgccccgcgccgcccgcccgcccgccatggagcccggccccgacggccccgccgcctccggccccgccgccatccgcgagggctggttccgcgagacctgcagcctgtggcccggccaggccctgtcactgcaggtggagcagctgctccaccaccggcgctcgcgctaccaggacatcctcgtcttccgcagagaacccaggtccccgactgtcactccgcccgcagtaagacctatggcaacgtgctggtgttggacggtgtcatccagtgcacggagagagacgagttctcctaccaggagatgatcgccaacctgcctctctgcagccaccccaacccgcgaaaggtgctgatcatcgggggcggagatggaggtgtcctgcgggaggtggtgaagcacccctccgtggagtccgtggtccagtgtgagatcgacgaggatgtcatccaagtctccaagaagttcctgccaggcatggccattggctactctagctcgaagctgaccctacatgtgggtgacggttttgagttcatgaaacagaatcaggatgccttcgacgtgatcatcactgactcctcagaccccatgggccccgccgaaagtctcttcaaggagtcctattaccagctcatgaagacagccctcaaggaagatggtgtcctctgctgccagg

SEQ ID NO: 185781 - DNA, 461 bp, Homo sapiens
  Payload ID: 16580
  Gene Symbol: SRM
  Gene Name: spermidine synthase
  ENST ID: ENST00000490101
  CDS Start-End: 1-250
cagcggccagatcggcttcatgctgtgcagcaagaacccgagcacgaacttccaggagccggtgcagccgctgacacagcagcaggtggcgcagatgcagctgaagtactacaactccgacgtgcaccgcgccgcctttgtgctgcccgagtttgcccgcaaggtgggtggcctgcggggctgggtggtgggacccagggacccagagcgccctcctgactggcctcatgtccctccaggccctgaatgatgtgagctgagcccaggcgccaccactgatgccacccaggacctcggaccttggagcctgcggggtgcctcggcccctccagccccgggccggacctcctgctggctctcgcccaccaaccaagtgttacaagccccagaatgctgcccggcctgccctgctgggcggactgtctgtgtgtctgtctctctggcgttccacctccaagcct

SEQ ID NO: 185782 - DNA, 402 bp, Homo sapiens
  Payload ID: 16580
  Gene Symbol: SRM
  Gene Name: spermidine synthase
  ENST ID: ENST00000465788
  CDS Start-End: 1-402
gagatggaggtgtcctgcgggaggtggtgaagcacccctccgtggagtccgtggtccagtgtgagatcgacgaggtgagtgccggcgtagagccaggtttgagtcctggttctcccagcggccagctgtgccctgaaatggctgcacacccccgagcaaggcaggatgtcatccaagtctccaagaagttcctgccaggcatggccattggctactctagctcgaagctgaccctacatgtgggtgacggttttgagttcatgaaacagaatcaggatgccttcgacgtgatcatcactgactcctcagaccccatgggccccgccgaaagtctcttcaaggagtcctattaccagctcatgaagacagccctcaaggaagatggtgtcctctgctgccagg

SEQ ID NO: 185783 - DNA, 611 bp, Homo sapiens
  Payload ID: 16580
  Gene Symbol: SRM
  Gene Name: spermidine synthase
  ENST ID: ENST00000487300
  CDS Start-End: 253-611
gcgggctggacctcgtcctgccctggccccctcgccacccctcacaccgcctccctgggctggggctgggactgcgggctggcctcttgggtgggggagtcggagtctgcgccccgctccacgtgtcagccctcaggacacgtcagagcccgaggagaccccgggtcccaccccggcctccacccggcggcccgcctgccgttcctcgccacgtgtcaccatcgctcctcatccctgggacccctaggcgggatggggagaccctcctcacccagggcggcttggggtacgttttccccaccccagagaacccaggtccccgactgtcactccgcccgcagtaagacctatggcaacgtgctggtgttggacggtgtcatccagtgcacggagagagacgagttctcctaccaggagatgatcgccaacctgcctctctgcagccaccccaacccgcgaaaggtgctgatcatcgggggcggagatggaggtgtcctgcgggaggtggtgaagcacccctccgtggagtccgtggtccagtgtgagatcgacgaggatgtcatccaagtctccaagaagttcctgccaggcatggccattggctactctag

SEQ ID NO: 185784 - DNA, 2192 bp, Homo sapiens
  Payload ID: 16581
  Gene Symbol: SATL1
  Gene Name: spermidine/spermine N1-acetyl transferase-like 1
  Uniprot ID: Q86VE3
  ENST ID: ENST00000395409
  CDS Start-End: 562-2088
atgaaccaatcaggcacgaaccaatcaagtttatcagactcgaaccaagcaggcataaaccagccaagcacaaactcacttggtatgaaccaaatggacatgaaccaagggagtgcaagcctatatgaaatgaaccaagtggacatgaaacaaccaagcatgagccaagctggcatgaggcaatcaggtacaaacctaccagacataaaccaacccgacatgaaacaaccagacacatggcaattaggtaggagccaaccaggcatgctgcaacaagaactgagccaactagtcctgagcaaagcaggcataagccaaccagacccatcgcaaccaggcccaagccaatcaggccccagccaatcacgcatgaggcaaataggcacgaaccaatcaggtatgagccaaccagtgatgcagcaactagacagccagtcaggtgggagccaaccaagcatgagacaagtaggcaccagccaattaggcacaagccaaataggcatgagccaaccaggcacatggcaaacaggactgagccaaccagtcctgaggcaaccaaacatgagtccaccaggcatgtggcaaccaggcgtgcaacaaccaggcatcagccagcaagtcccaagccacccagacatgagtcaaccaggcatgagccagcaagtccccagccaaccaggcataaggcaaccagacactagccaatcatgtaagaaccaaacagacatgagccaaccagacgcaaaccaatcaagtttatcagattccaaccaaacaggtataatccagccaagcccaagcttacttggtatgaaccaaatggacatgaaccaatggagtgcaagcctatatgaaatgaaccaagtggacatgaaacaaccaagcatgagccaagctggcatgaggcaatcaggtacaaacctaccagacataaaccaacctggcatgaaacaaccaggcacatggcaattaggtaggagccaaccaggcatgtggccacaaagcctgagcgaactagtcctgagtgaagcaagcataagccaaccaggtccaccgcaacgagccccaagccaatcaggccccagacaatcaagcacgagccaagcaggcacaaaccaatcaggtataagccaaccagtgatgtggcaactagacatgagacagtcaggtgggagccaaccaagcatgagacaagtaggcaccagccaatcaggcacaagccaaataggcatgagccaaccaggcacatggcaaacaggcctgagccaaccagtcccgaggcaaccaaacaagagtccaccaggcatgtggcaacgaggcatgtggcaaccaggcatgagccagcaagtccccagccaactaggcatgagacaaccaggcactagccaatcaagtaagaaccaaacaggcatgagccatccaggcaggggccaaccaggcatatgggaaccggggccgagtcagccaggcctgagccaacaagacctgaaccaattagtgctgagccaaccaggcctgagtcaaccaggcaggagccaaccaagtgtgagccaaatgggcatgaggcaaacaagcatggattactttcaaataagacatgcagaggctggagactgcccagaaattttgcgactgattaaagaattggctgcctgtgaaaacatgctagatgcaatggagttaacagcagctgatttactcagagatggctttggggacaatccccttttctactgcctgattgcagaagtaaacgatcaacaaaaaccatcaggcaaactgactgttggatttgccatgtactactttacatacgactcatggactggcaaggtactttacctagaggacttttatgtcacacaagcttaccaaggcctaggtattggagctgaaatgctgaagaggctaagtcagatagccatcacaactcaatgtaactgcatgcactttcttgtcgtcatttggaaccaggcttctatcaactactatactagtcgaggggctttagacctttcctctgaggagggctggcatctcttcaggtttaacagagaagaactcctggacatggcatgggaagaatgaaagaggctttgtaacaactcatcccaacacagcctccaacatttgactgtcacctgagtctaacagcagtttgactttgttgtacaatacagcaagtgatcatc

SEQ ID NO: 185785 - DNA, 2224 bp, Homo sapiens
  Payload ID: 16581
  Gene Symbol: SATL1
  Gene Name: spermidine/spermine N1-acetyl transferase-like 1
  Uniprot ID: Q86VE3
  ENST ID: ENST00000509231
  CDS Start-End: 81-1979
cagccatcagccaatcagttgtctgccaacccatcatctgccaccccatccttagtcaacaaagcaggaatcaactgggcatgaaccaatcaggcacgaaccaatcaagtttatcagactcgaaccaagcaggcataaaccagccaagcacaaactcacttggtatgaaccaaatggacatgaaccaagggagtgcaagcctatatgaaatgaaccaagtggacatgaaacaaccaagcatgagccaagctggcatgaggcaatcaggtacaaacctaccagacataaaccaacccgacatgaaacaaccagacacatggcaattaggtaggagccaaccaggcatgctgcaacaagaactgagccaactagtcctgagcaaagcaggcataagccaaccagacccatcgcaaccaggcccaagccaatcaggccccagccaatcacgcatgaggcaaataggcacgaaccaatcaggtatgagccaaccagtgatgcagcaactagacagccagtcaggtgggagccaaccaagcatgagacaagtaggcaccagccaattaggcacaagccaaataggcatgagccaaccaggcacatggcaaacaggactgagccaaccagtcctgaggcaaccaaacatgagtccaccaggcatgtggcaaccaggcgtgcaacaaccaggcatcagccagcaagtcccaagccacccagacatgagtcaaccaggcatgagccagcaagtccccagccaaccaggcataaggcaaccagacactagccaatcatgtaagaaccaaacagacatgagccaaccagacgcaaaccaatcaagtttatcagattccaaccaaacaggtataatccagccaagcccaagcttacttggtatgaaccaaatggacatgaaccaatggagtgcaagcctatatgaaatgaaccaagtggacatgaaacaaccaagcatgagccaagctggcatgaggcaatcaggtacaaacctaccagacataaaccaacctggcatgaaacaaccaggcacatggcaattaggtaggagccaaccaggcatgtggccacaaagcctgagcgaactagtcctgagtgaagcaagcataagccaaccaggtccaccgcaacgagccccaagccaatcaggccccagacaatcaagcacgagccaagcaggcacaaaccaatcaggtataagccaaccagtgatgtggcaactagacatgagacagtcaggtgggagccaaccaagcatgagacaagtaggcaccagccaatcaggcacaagccaaataggcatgagccaaccaggcacatggcaaacaggcctgagccaaccagtcccgaggcaaccaaacaagagtccaccaggcatgtggcaacgaggcatgtggcaaccaggcatgagccagcaagtccccagccaactaggcatgagacaaccaggcactagccaatcaagtaagaaccaaacaggcatgagccatccaggcaggggccaaccaggcatatgggaaccggggccgagtcagccaggcctgagccaacaagacctgaaccaattagtgctgagccaaccaggcctgagtcaaccaggcaggagccaaccaagtgtgagccaaatgggcatgaggcaaacaagcatggattactttcaaataagacatgcagaggctggagactgcccagaaattttgcgactgattaaagaattggctgcctgtgaaaacatgctagatgcaatggagttaacagcagctgatttactcagagatggctttggggacaatccccttttctactgcctgattgcagaagtaaacgatcaacaaaaaccatcaggcaaactgactgttggatttgccatgtactactttacatacgactcatggactggcaaggtactttacctagaggacttttatgtcacacaagcttaccaagatagccatcacaactcaatgtaactgcatgcactttcttgtcgtcatttggaaccaggcttctatcaactactatactagtcgaggggctttagacctttcctctgaggagggctggcatctcttcaggtttaacagagaagaactcctggacatggcatgggaagaatgaaagaggctttgtaacaactcatcccaacacagcctccaacatttgactgtcacctgagtctaacagcagtttgactttgttgtacaatacagcaagt

SEQ ID NO: 185786 - DNA, 801 bp, Homo sapiens
  Payload ID: 16582
  Gene Symbol: SAT1
  Gene Name: spermidine/spermine N1-acetyltransferase 1
  ENST ID: ENST00000379251
  CDS Start-End: 180-632
gcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaaggtaattcaacagtggcgggacgggggacaagcgttcggtgcctgtcaccttcgccaaggccattaccgcccctgctcccccttcttgcagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatg

SEQ ID NO: 185787 - DNA, 909 bp, Homo sapiens
  Payload ID: 16582
  Gene Symbol: SAT1
  Gene Name: spermidine/spermine N1-acetyltransferase 1
  ENST ID: ENST00000379253
  CDS Start-End: 180-542
gcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggttttggagagcaccccttttaccactgcctggttgcagaagtgccgaaagagcactggactccggaaggtaacccctcgccctttccagaagccagagagaccaagtgttatgtaagaagtagtgtcggctgtgtagaaccactgactacacaggccgaagttactgagaacttggacagaaaaaatagccagcaagtgttcaaactactgaggaaaaaaaaaaattagatatgctgcacttaagaatactagggcaggttaaaagagctgtttaagtaagtatcagagtgctgtggagactcggaagtgtttaagctgcttaagtaagtataagtgctgtggagacccggaagagttagatataatgtcatttgttgtaattcagtttcataaaatggttcttgtttgaccctaacgtaacagtttttgtaattgtgttaaatcacatttttttctttaatttgtcccaatcttcaggttacagtctctagcttcgccatgtacatggcccttccgtgtacatggatgggcggggaggtaactaaaagatcctttacacaataaagtagatgatcatgataaatgaggtaaggtc

SEQ ID NO: 185788 - DNA, 868 bp, Homo sapiens
  Payload ID: 16582
  Gene Symbol: SAT1
  Gene Name: spermidine/spermine N1-acetyltransferase 1
  ENST ID: ENST00000379254
  CDS Start-End: 180-611
gcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaaggacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaa

SEQ ID NO: 185789 - DNA, 1065 bp, Homo sapiens
  Payload ID: 16582
  Gene Symbol: SAT1
  Gene Name: spermidine/spermine N1-acetyltransferase 1
  Uniprot ID: P21673
  ENST ID: ENST00000379270
  CDS Start-End: 180-695
gcgcagctcttagtcgcgggccgactggtgtttatccgtcactcgccgaggttccttgggtcatggtgccagcctgactgagaagaggacgctcccgggagacgaatgaggaaccacctcctcctactgttcaagtacaggggcctggtccgcaaagggaagaaaagcaaaagacgaaaatggctaaattcgtgatccgcccagccactgccgccgactgcagtgacatactgcggctgatcaaggagctggctaaatatgaatacatggaagaacaagtaatcttaactgaaaaagatctgctagaagatggttttggagagcaccccttttaccactgcctggttgcagaagtgccgaaagagcactggactccggaaggacacagcattgttggttttgccatgtactattttacctatgacccgtggattggcaagttattgtatcttgaggacttcttcgtgatgagtgattatagaggctttggcataggatcagaaattctgaagaatctaagccaggttgcaatgaggtgtcgctgcagcagcatgcacttcttggtagcagaatggaatgaaccatccatcaacttctataaaagaagaggtgcttctgatctgtccagtgaagagggttggagactgttcaagatcgacaaggagtacttgctaaaaatggcaacagaggagtgaggagtgctgctgtagatgacaacctccattctattttagaataaattcccaacttctcttgctttctatgctgtttgtagtgaaataatagaatgagcacccattccaaagctttattaccagtggcgttgttgcatgtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttgatttaattgtttggtgtaagca

SEQ ID NO: 185790 - DNA, 946 bp, Homo sapiens
  Payload ID: 16583
  Gene Symbol: SAT2
  Gene Name: spermidine/spermine N1-acetyltransferase family member 2
  Uniprot ID: Q96F10
  ENST ID: ENST00000269298
  CDS Start-End: 221-733
atgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggagctagccgaattcgaaaaactctcggatcaggtgaagatcagtgaagaagccctgagagcagatggctttggagacaatcctttctatcactgtttggtagcagagattcttccagcgcccgggaagctactggggccctgcgtggtgggctatgggatatactatttcatctacagtacatggaagggacgcaccatttatctggaggatatctatgtgatgccggaatatcggggtcaagggattggttccaaaataatcaaaaaggtggctgaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaaggagggttaggggtgcctatcctcaagtattggaagagcagaattgagggagagacctttcttccttgttgagggtgaaaaataaataagaattacatgtcctga

SEQ ID NO: 185791 - DNA, 640 bp, Homo sapiens
  Payload ID: 16583
  Gene Symbol: SAT2
  Gene Name: spermidine/spermine N1-acetyltransferase family member 2
  ENST ID: ENST00000573566
  CDS Start-End: 171-581
cgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggagctagccgaattcgaaaaactctcggatcaggtgaagatcagtgaagaagccctgagagcagatggctttggagacaatcctttctatcactgtttggtagcagagattcttccagcgcccgggaagctactgggtcaagggattggttccaaaataatcaaaaaggtggctgaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactc

SEQ ID NO: 185792 - DNA, 838 bp, Homo sapiens
  Payload ID: 16583
  Gene Symbol: SAT2
  Gene Name: spermidine/spermine N1-acetyltransferase family member 2
  ENST ID: ENST00000575826
  CDS Start-End: 162-287
cccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggagctagccgaattcgaaaaactctcggatcaggtgaagatcagtgaagaagccctgagagcagatggctttggagacaatcctttctatcactgtttggtagcagagattcttccagcgcccgggaagctactggggccctgcgtggtgggctatgggatatactatttcatctacagtacatggaagggacgcaccatttatctggaggatatctatgtgatgccggaatatcggggtcaagggattggttccaaaataatcaaaaaggtggctgaggtgaggagatgggtggggcgacaagtgaggacctgaagaagcaagggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggag

SEQ ID NO: 185793 - DNA, 860 bp, Homo sapiens
  Payload ID: 16583
  Gene Symbol: SAT2
  Gene Name: spermidine/spermine N1-acetyltransferase family member 2
  ENST ID: ENST00000571074
  CDS Start-End: 225-350
ggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggagctagccgaattcgaaaaactctcggatcaggtgaagatcagtgaagaagccctgagagcagatggctttggagacaatcctttctatcactgtttggtagcagagattcttccagcgcccgggaagctactggggccctgcgtggtgggctatgggatatactatttcatctacagtacatggaagggacgcaccatttatctggaggatatctatgtgatgccggaatatcggggtcaagggattggttccaaaataatcaaaaaggtggctgaggtggccttggataagggctgctcccaattccgcctggccgtcctggactggaaccagagggccatggacttgtacaaggccctaggagcccaagatctgacggaagctgagggctggcacttcttctgctttcaaggagaggcaacgagaaagttggcaggaaagtgacgccatccctaggaggatctctgtcttgagtttctccttccccatcagctgaagcactcttcagagactacgtccacagacactgatgctgaggcctccctggaggaagg

SEQ ID NO: 185794 - DNA, 2164 bp, Homo sapiens
  Payload ID: 16584
  Gene Symbol: SMOX
  Gene Name: spermine oxidase
  Uniprot ID: Q9NWM0
  ENST ID: ENST00000278795
  CDS Start-End: 226-1824
gccgggccggagcggggtgggtaggggacgcgaggcggagcggggccccacacaggccgcggcggctggctcgggcccctacggtcccggcggcggctggaggaggaagccaggcggctggcggaggaggagagacggaggaggccgagaccggagcgccgctcgccgcagacttacttccccggctcagcagggaaaggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacagagagctcaaagacagcgcatggaagctccacaaagcagcagcctggtcaccttttctcttccaagtgcccagaacagcccctggatgctaacaggggcgccgtaaagcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcccctcagcttctctctggttttctca

SEQ ID NO: 185795 - DNA, 2233 bp, Homo sapiens
  Payload ID: 16584
  Gene Symbol: SMOX
  Gene Name: spermine oxidase
  Uniprot ID: Q9NWM0
  ENST ID: ENST00000305958
  CDS Start-End: 226-1893
gccgggccggagcggggtgggtaggggacgcgaggcggagcggggccccacacaggccgcggcggctggctcgggcccctacggtcccggcggcggctggaggaggaagccaggcggctggcggaggaggagagacggaggaggccgagaccggagcgccgctcgccgcagacttacttccccggctcagcagggaaaggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgagggcgaccacaatcacgacactggggagggtggccagggtggagaggagccccgggggggcaggtgggatgaggatgagcagtggtcggtggtggtggagtgcgaggactgtgagctgatcccggcggaccatgtgattgtgaccgtgtcgctaggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacagagagctcaaagacagcgcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcccctcagcttctctctggttttctca

SEQ ID NO: 185796 - DNA, 982 bp, Homo sapiens
  Payload ID: 16584
  Gene Symbol: SMOX
  Gene Name: spermine oxidase
  Uniprot ID: Q9NWM0
  ENST ID: ENST00000346595
  CDS Start-End: 70-642
cgccgctcgccgcagacttacttccccggctcagcagggaaaggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgagcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcccctcagcttctctctggttttctca

SEQ ID NO: 185797 - DNA, 2074 bp, Homo sapiens
  Payload ID: 16584
  Gene Symbol: SMOX
  Gene Name: spermine oxidase
  Uniprot ID: Q9NWM0
  ENST ID: ENST00000339123
  CDS Start-End: 226-1734
gccgggccggagcggggtgggtaggggacgcgaggcggagcggggccccacacaggccgcggcggctggctcgggcccctacggtcccggcggcggctggaggaggaagccaggcggctggcggaggaggagagacggaggaggccgagaccggagcgccgctcgccgcagacttacttccccggctcagcagggaaaggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacagagagctcaaagacagcgcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcccctcagcttctctctggttttctca

SEQ ID NO: 185798 - DNA, 2230 bp, Homo sapiens
  Payload ID: 16584
  Gene Symbol: SMOX
  Gene Name: spermine oxidase
  Uniprot ID: Q9NWM0
  ENST ID: ENST00000379460
  CDS Start-End: 223-1890
ctttctgtgctgatcttggaggcagagtggctgcctgcattcattccacggtccattccacagcttgttccaaagacagtctgctcatgatgtagcttctgcacttgacaaattattttcatgcacgaggcccttgaaaatgttgacagtcttgtgacatccatggagggccttatttgacggtcacaaaggagcggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgagggcgaccacaatcacgacactggggagggtggccagggtggagaggagccccgggggggcaggtgggatgaggatgagcagtggtcggtggtggtggagtgcgaggactgtgagctgatcccggcggaccatgtgattgtgaccgtgtcgctaggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacagagagctcaaagacagcgcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcccctcagcttctctctggttttctca

SEQ ID NO: 185799 - DNA, 1669 bp, Homo sapiens
  Payload ID: 16584
  Gene Symbol: SMOX
  Gene Name: spermine oxidase
  ENST ID: ENST00000457205
  CDS Start-End: 1-1329
aacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgagggcgaccacaatcacgacactggggagggtggccagggtggagaggagccccgggggggcaggtgggatgaggatgagcagtggtcggtggtggtggagtgcgaggactgtgagctgatcccggcggaccatgtgattgtgaccgtgtcgctaggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacagagagctcaaagacagcgcatggaagctccacaaagcagcagcctggtcaccttttctcttccaagtgcccagaacagcccctggatgctaacaggggcgccgtaaagcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcccctcagcttctctctggttttctca

SEQ ID NO: 185800 - DNA, 2322 bp, Homo sapiens
  Payload ID: 16584
  Gene Symbol: SMOX
  Gene Name: spermine oxidase
  Uniprot ID: Q9NWM0
  ENST ID: ENST00000621355
  CDS Start-End: 226-1983
gccgggccggagcggggtgggtaggggacgcgaggcggagcggggccccacacaggccgcggcggctggctcgggcccctacggtcccggcggcggctggaggaggaagccaggcggctggcggaggaggagagacggaggaggccgagaccggagcgccgctcgccgcagacttacttccccggctcagcagggaaaggttcctagaaggtgagcgcggacggtatgcaaagttgtgaatccagtggtgacagtgcggatgaccctctcagtcgcggcctacggagaaggggacagcctcgtgtggtggtgatcggcgccggcttggctggcctggctgcagccaaagcacttcttgagcagggtttcacggatgtcactgtgcttgaggcttccagccacatcggaggccgtgtgcagagtgtgaaacttggacacgccacctttgagctgggagccacctggatccatggctcccatgggaaccctatctatcatctagcagaagccaacggcctcctggaagagacaaccgatggggaacgcagcgtgggccgcatcagcctctattccaagaatggcgtggcctgctaccttaccaaccacggccgcaggatccccaaggacgtggttgaggaattcagcgatttatacaacgaggtctataacttgacccaggagttcttccggcacgataaaccagtcaatgctgaaagtcaaaatagcgtgggggtgttcacccgagaggaggtgcgtaaccgcatcaggaatgaccctgacgacccagaggctaccaagcgcctgaagctcgccatgatccagcagtacctgaaggtggagagctgtgagagcagctcacacagcatggacgaggtgtccctgagcgccttcggggagtggaccgagatccccggcgctcaccacatcatcccctcgggcttcatgcgggttgtggagctgctggcggagggcatccctgcccacgtcatccagctagggaaacctgtccgctgcattcactgggaccaggcctcagcccgccccagaggccctgagattgagccccggggtgagggcgaccacaatcacgacactggggagggtggccagggtggagaggagccccgggggggcaggtgggatgaggatgagcagtggtcggtggtggtggagtgcgaggactgtgagctgatcccggcggaccatgtgattgtgaccgtgtcgctaggtgtgctaaagaggcagtacaccagtttcttccggccaggcctgcccacagagaaggtggctgccatccaccgcctgggcattggcaccaccgacaagatctttctggaattcgaggagcccttctggggccctgagtgcaacagcctacagtttgtgtgggaggacgaagcagagagccacaccctcacctacccacctgagctctggtaccgcaagatctgcggctttgatgtcctctacccgcctgagcgctacggccatgtgctgagcggctggatctgcggggaggaggccctcgtcatggagaagtgtgatgacgaggcagtggccgagatctgcacggagatgctgcgtcagttcacagggaaccccaacattccaaaacctcggcgaatcttgcgctcggcctggggcagcaacccttacttccgcggctcctattcatacacgcaggtgggctccagcggggcggatgtggagaagctggccaagcccctgccgtacacagagagctcaaagacagcgcatggaagctccacaaagcagcagcctggtcaccttttctcttccaagtgcccagaacagcccctggatgctaacaggggcgccgtaaagcccatgcaggtgctgttttccggtgaggccacccaccgcaagtactattccaccacccacggtgctctgctgtccggccagcgtgaggctgcccgcctcattgagatgtaccgagacctcttccagcaggggacctgagggctgtcctcgctgctgagaagagccactaactcgtgacctccagcctgccccttgctgccgtgtgctcctgccttcctgatcctctgtagaaaggatttttatcttctgtagagctagccgccctgactgccttcagacctggccctgtagcttttctttttctccaggctgggccgtgagcaggtgggccgttgagttacctctgtgctggatcccgtgcccccacttgcctaccctctgtcctgccttgttattgtaagtgccttcaatactttgcattttgggataataaaaaaggctccctcccctgcccctcagcttctctctggttttctc

SEQ ID NO: 185801 - DNA, 1174 bp, Homo sapiens
  Payload ID: 16585
  Gene Symbol: SMS
  Gene Name: spermine synthase
  Uniprot ID: P52788
  ENST ID: ENST00000379404
  CDS Start-End: 111-1052
ggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaat

SEQ ID NO: 185802 - DNA, 1837 bp, Homo sapiens
  Payload ID: 16585
  Gene Symbol: SMS
  Gene Name: spermine synthase
  Uniprot ID: P52788
  ENST ID: ENST00000404933
  CDS Start-End: 253-1353
gtttccaccattagcgaggcctcacacccggcgctccaagttcggggctggaggcgtcccggcttcctccctcccggagcgggaccggccccgcccccgcgccccgggtcgctcccggcggcccctcccacctcctagtcctggcctccccgggcgcagcacactcccagccggccgcagcctgacacgccgcgcggccccccagtctcccgcggctgctcccccaggcatggcacagggcctcgcctcactatggcagcagcacggcacagcacgctcgacttcatgctcggcgccaaagctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggtagagattgaccaaatggtgattgatgggtgtaagaaatacatgcgaaaaacgtgtggcgatgtcttagacaatcttaaaggagactgctatcaggttctaatagaagactgtatcccggtactgaagaggtacgccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgacagaagcactgtcgctctatgaagaacagctggggcgcctgtattgtcctgtggaattttcaaaggagatcgtctgtgtcccttcatacttggaattgtgggtattttacactgtttggaagaaagctaaaccctgaagatcagtagcccctaatcacatgtgctgcaaatagccttcctgacctccatatgctgtacatgacatcaaaatgagtcaggcaattgattgtgaattccttaaagttttcctttttttaataattatttttaatttaaaaaagcaaatggaaaatgtatattttgatgagcttagggtgttttttttttgaaagtcagctgaaggatggttagacagcacagcgaagactgctaaatgcactgaccccccccattagaatgtgatttttgttcctttttatttctctgtgggcttttgtttttgtttttgttttggtagatcttcaatttggatatttggaggagtgaacatcgttgttttgctggagggaagatcttgatggtgtttctttccccaaaaattgacttagatattaaaatttggtgcttataagagagagttaaaaaaaaataggattgcttcaattaaaattacaaaagaga

SEQ ID NO: 185803 - DNA, 931 bp, Homo sapiens
  Payload ID: 16585
  Gene Symbol: SMS
  Gene Name: spermine synthase
  ENST ID: ENST00000457085
  CDS Start-End: 1-931
cggcggtcgggcggaggccgcgctcctgctggctccgcgctccgtcccggccgcagctcggggcctgcaggggcagtcccgggtgcccgccggccgcgccgcccttccgggccctggccgtccacccgcgctcccacgcgggctcgccgccttcgcgctcccgctcggggagtccccgggctgccgggcgcgggcggaccccccatgggacgagggttgcagggactgcggcggagcgaggcgtgacccgcgcggcgagcccgggctgggggcgtgcgccgagcggggctgcccgcgcgaccttttcctgttcttgcaggcggctgatggtgagaccattctaaaaggcctccagtccattttccaggagcaggggatggcggagtcggtgcacacctggcaggaccatggctatttagcaacctacacaaacaagaacggcagctttgccaatttgagaatttacccacatggattggtgttgctggaccttcagagttatgatggtgatgcgcaaggcaaagaagagatcgacagtattttgaacaaagtagaggaaagaatgaaagaattgagtcaggacagtactgggcgggtgaaacgattaccacccatagtgcgaggaggagccatcgacagatactggcccaccgccgacgggcgcctggttgaatatgacatagatgaagtggtatatgacgaagattcaccttatcaaaatataaaaattctacactcgaagcagtttggaaatattctcatccttagtggggatgttaatttggcagagagtgatttggcatatacccgggccatcatgggcagtggcaaagaagattacactggcaaagatgtactcattctgggaggtggagacggaggcatattgtgtgaaatagtcaaactaaaaccaaagatggtcactatggta

SEQ ID NO: 185804 - DNA, 2544 bp, Homo sapiens
  Payload ID: 16586
  Gene Symbol: STPG1
  Gene Name: sperm-tail PG-rich repeat containing 1
  Uniprot ID: Q5TH74
  ENST ID: ENST00000003583
  CDS Start-End: 143-1006
atagcgaccgggaggttgggctggccagattcagctgccgggaccggaccaggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccgaaaaaccccatcctgaacttctctgctcagccttcgcctctgcctccgaagccacctttcccaggtcctggtcagtatgagatcgtggactacttaggcccccgcaagcatttcatctctagtgcatcattcgtgtccaataccagccggtggacagcggcgccgcctcagccaggcctgcctggcccagctacgtacaagccagagcttccaggaaagcagtccttcctctacaacgaggacaagaaatggatcccggttctgtagggatgtcacacaaggtcaaggagaactccagccaccagcccaccctgcccagcgtccccaggacattcctcaggaggagaccgatcatgagtgtggcagctgacaacttggggggtggctctaccactctggcctggcatcctagccggactgctgccattgcctttgtcttgagctggagacattgctccctggagacttcaccccagccccacagactccagtggcttcctgagcagaagggaggagtggacagagccccctggctgcttccccacgcacccatccaggctgccttccggcacgactccctgccgcagactgaagggactcctgaagcgcagacttcaaggaggatcagtccaccctgaaggtggccaagcctggaagccccacccttccctgtttcattccttcattcatttacacattcattcattccctcactcctgcctttctcatttgtccctttctgacctcactcacttacggtatgtctactgggcgaaagctacctgcaggcaggtgatgctttttccaccagtccacagcttcctttctaaagtgaccacctgtttggaaagacctctctttactccttttagacctttttctctttggagtgggagatcatcttggaatggcagtggccgggcccgggggctgcgcttttccctgactttctctgctggcgggactgaattttctcaaggcttacaggcccttccatggagtccacatggcctgtctaggcctgatagctttcgtctctctatgtggagggaaaaagaaatgtgccctagtggttttggtggaggctgcacagattcgcggtgggtggggagctgccaggctccttttctgatctcccagcaggctttgactgacgctgtttagtctttctgtacattaaccccgccagataccgagaggttacaaagcctccaaggcctgtacaactgtggcctctccagagaagtggttctcagccttgactgcacactgtaatcacctggggactttaaaaagtactgaggcctggggcccacccacaaatgctgatttaactcctccagggtggggtctgggcagtggggaggcaggagccacccaggtgattccaatgataggtgtaggttgagaagcgccaccttccagcttcctaactggctctgggaggggagctgggtgggaagttcaggaggtgggaactttgtacacgcagagcacctggagcacctacagcatggctgtggttccacactcctctgtcatttaaccttcacacatcacctcgttctgacatcaagggtgcgtcacagccacagtgaggcctcgcctgggcagagcaactctgggtgccccactgggtccctcccacaggggcaggcaagcctaatgggaacccgaggcaaaaggaaacatcagtaatacgaatcctgtctttaaaactgtgatgttttgttcaccatggattttttttttgggggggggggccttaattttaaaaatattgcattaaacttatttatcttgct

SEQ ID NO: 185805 - DNA, 2715 bp, Homo sapiens
  Payload ID: 16586
  Gene Symbol: STPG1
  Gene Name: sperm-tail PG-rich repeat containing 1
  Uniprot ID: Q5TH74
  ENST ID: ENST00000337248
  CDS Start-End: 168-1172
cgcggacggcggaaggtggactcgcgaatgttaggcctgtgggtgccatagcgaccgggaggttgggctggccagattcagctgccgggaccggaccaggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaaggttttactgctgcatatccaacacaatcctccattccttttaaatctcaagcttcagtaatcccagaatcagaaaaaaaaggattcaatagtcaagccaagagatttcctcataagaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccgaaaaaccccatcctgaacttctctgctcagccttcgcctctgcctccgaagccacctttcccaggtcctggtcagtatgagatcgtggactacttaggcccccgcaagcatttcatctctagtgcatcattcgtgtccaataccagccggtggacagcggcgccgcctcagccaggcctgcctggcccagctacgtacaagccagagcttccaggaaagcagtccttcctctacaacgaggacaagaaatggatcccggttctgtagggatgtcacacaaggtcaaggagaactccagccaccagcccaccctgcccagcgtccccaggacattcctcaggaggagaccgatcatgagtgtggcagctgacaacttggggggtggctctaccactctggcctggcatcctagccggactgctgccattgcctttgtcttgagctggagacattgctccctggagacttcaccccagccccacagactccagtggcttcctgagcagaagggaggagtggacagagccccctggctgcttccccacgcacccatccaggctgccttccggcacgactccctgccgcagactgaagggactcctgaagcgcagacttcaaggaggatcagtccaccctgaaggtggccaagcctggaagccccacccttccctgtttcattccttcattcatttacacattcattcattccctcactcctgcctttctcatttgtccctttctgacctcactcacttacggtatgtctactgggcgaaagctacctgcaggcaggtgatgctttttccaccagtccacagcttcctttctaaagtgaccacctgtttggaaagacctctctttactccttttagacctttttctctttggagtgggagatcatcttggaatggcagtggccgggcccgggggctgcgcttttccctgactttctctgctggcgggactgaattttctcaaggcttacaggcccttccatggagtccacatggcctgtctaggcctgatagctttcgtctctctatgtggagggaaaaagaaatgtgccctagtggttttggtggaggctgcacagattcgcggtgggtggggagctgccaggctccttttctgatctcccagcaggctttgactgacgctgtttagtctttctgtacattaaccccgccagataccgagaggttacaaagcctccaaggcctgtacaactgtggcctctccagagaagtggttctcagccttgactgcacactgtaatcacctggggactttaaaaagtactgaggcctggggcccacccacaaatgctgatttaactcctccagggtggggtctgggcagtggggaggcaggagccacccaggtgattccaatgataggtgtaggttgagaagcgccaccttccagcttcctaactggctctgggaggggagctgggtgggaagttcaggaggtgggaactttgtacacgcagagcacctggagcacctacagcatggctgtggttccacactcctctgtcatttaaccttcacacatcacctcgttctgacatcaagggtgcgtcacagccacagtgaggcctcgcctgggcagagcaactctgggtgccccactgggtccctcccacaggggcaggcaagcctaatgggaacccgaggcaaaaggaaacatcagtaatacgaatcctgtctttaaaactgtgatgttttgttcaccatggattttttttttgggggggggggccttaattttaaaaatattgcattaaacttatttatcttgcttattg

SEQ ID NO: 185806 - DNA, 2804 bp, Homo sapiens
  Payload ID: 16586
  Gene Symbol: STPG1
  Gene Name: sperm-tail PG-rich repeat containing 1
  Uniprot ID: Q5TH74
  ENST ID: ENST00000374409
  CDS Start-End: 256-1260
tcgtcacagccatgagtgagacttgaagcccgttttacgtatgaagaaatgtcatttgggcctagacatcaacaatgagaaagaggcagttctagtctcagatcgtggggcagagaaagctccttgggaacatgggagaggaacgagttggtgcattgtagaaactgcccgaaggccagcagggctggtgcttaggagaacatgcagtagaacttttcatcaaacaaatggaacacgtcacagaattttgctaacatggacaactctgcacagaaaaatgaacgcactggcaaacatcccagacgtgccagtgaagtacagaaaggttttactgctgcatatccaacacaatcctccattccttttaaatctcaagcttcagtaatcccagaatcagaaaaaaaaggattcaatagtcaagccaagagatttcctcataagaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccgaaaaaccccatcctgaacttctctgctcagccttcgcctctgcctccgaagccacctttcccaggtcctggtcagtatgagatcgtggactacttaggcccccgcaagcatttcatctctagtgcatcattcgtgtccaataccagccggtggacagcggcgccgcctcagccaggcctgcctggcccagctacgtacaagccagagcttccaggaaagcagtccttcctctacaacgaggacaagaaatggatcccggttctgtagggatgtcacacaaggtcaaggagaactccagccaccagcccaccctgcccagcgtccccaggacattcctcaggaggagaccgatcatgagtgtggcagctgacaacttggggggtggctctaccactctggcctggcatcctagccggactgctgccattgcctttgtcttgagctggagacattgctccctggagacttcaccccagccccacagactccagtggcttcctgagcagaagggaggagtggacagagccccctggctgcttccccacgcacccatccaggctgccttccggcacgactccctgccgcagactgaagggactcctgaagcgcagacttcaaggaggatcagtccaccctgaaggtggccaagcctggaagccccacccttccctgtttcattccttcattcatttacacattcattcattccctcactcctgcctttctcatttgtccctttctgacctcactcacttacggtatgtctactgggcgaaagctacctgcaggcaggtgatgctttttccaccagtccacagcttcctttctaaagtgaccacctgtttggaaagacctctctttactccttttagacctttttctctttggagtgggagatcatcttggaatggcagtggccgggcccgggggctgcgcttttccctgactttctctgctggcgggactgaattttctcaaggcttacaggcccttccatggagtccacatggcctgtctaggcctgatagctttcgtctctctatgtggagggaaaaagaaatgtgccctagtggttttggtggaggctgcacagattcgcggtgggtggggagctgccaggctccttttctgatctcccagcaggctttgactgacgctgtttagtctttctgtacattaaccccgccagataccgagaggttacaaagcctccaaggcctgtacaactgtggcctctccagagaagtggttctcagccttgactgcacactgtaatcacctggggactttaaaaagtactgaggcctggggcccacccacaaatgctgatttaactcctccagggtggggtctgggcagtggggaggcaggagccacccaggtgattccaatgataggtgtaggttgagaagcgccaccttccagcttcctaactggctctgggaggggagctgggtgggaagttcaggaggtgggaactttgtacacgcagagcacctggagcacctacagcatggctgtggttccacactcctctgtcatttaaccttcacacatcacctcgttctgacatcaagggtgcgtcacagccacagtgaggcctcgcctgggcagagcaactctgggtgccccactgggtccctcccacaggggcaggcaagcctaatgggaacccgaggcaaaaggaaacatcagtaatacgaatcctgtctttaaaactgtgatgttttgttcaccatggattttttttttgggggggggggccttaattttaaaaatattgcattaaacttatttatcttgcttattga

SEQ ID NO: 185807 - DNA, 772 bp, Homo sapiens
  Payload ID: 16586
  Gene Symbol: STPG1
  Gene Name: sperm-tail PG-rich repeat containing 1
  ENST ID: ENST00000435187
  CDS Start-End: 1-434
gttttactgctgcatatccaacacaatcctccattccttttaaatctcaagcttcagtaatcccagaatcagaaaaaaaaggattcaatagtcaagccaagagatttcctcataagaagaatgatatcccaggacctgggttctacaatgttattcaccagtcaccggtgtccaacagtgtctcattgtccaagaaaggaacttgcatgtttccctcaatgtgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgtaagaactctgcctatgcttgctaaatacagatcgaattaatggtttactaaaataaaaggaagaggggatcttggggacatcgtattttaatgcagttgtcaagccagttagcatttgttgactacccaatgggtgcctaaggctgtacaagactcttacagggaatttgcagaccccagagatcaggatgggcaacatggaggccagtatcaagctgtggggaggccactgccctgagaaacacatattctaattactcttgtcctgtaacctttctgggacgtagttttctcatctgtaacaatgggtgtattatttaccactttgtctgcagccactaatgatttactttttaggttcttctagggaaaataaac

SEQ ID NO: 185808 - DNA, 811 bp, Homo sapiens
  Payload ID: 16586
  Gene Symbol: STPG1
  Gene Name: sperm-tail PG-rich repeat containing 1
  ENST ID: ENST00000438866
  CDS Start-End: 1-507
tgcgcccgattggacaccatcatttctaaataccctgcagcgaatgcatacactatcccatcggattttatttccaagagagactttagtaattcgtgttccagcatgttccagttgccaagctttatgaaagctctcaagtttgaaactcctgcaccaaactattacaatgcctctgtctcttgctgcaagcagagaaacaacgtctgtactcgagccgggtttatgtcaaaaacccaaagaggatctttcgcttttgctgataaaggacctcccccagggcattatgatatcaacgaatcccttgtgaagcagtcgccaaatacattaatgtcttgttttaaatcaaaaaccaaccgtggattaaaactgacgtcaacaggcccgggacctggttattacaaccccagtgattgcacaaaagttccaaaaaagactcttttcccaggaggaagcaaggcttcggatttggcgggacatttgcccaagtccacacagccaacttgaggagccacagggaattggctcaggactaagtctttcctcattccctgtgatgctggattcccctggtgctgacattgttctatttttgtaacataaaatcttcgctggagtggcaggacattcagaagcagtcaagctctcatagctttataccgatggaagtttaagccctgactttcgagttggtgatacctgctggatttgtacttcagctctgctgtttttatgctctgtgaccttgggcagagttctaacctctctgagcctccatgccctcatctgtaaggtgggaataattcctgcc

SEQ ID NO: 185809 - DNA, 1652 bp, Homo sapiens
  Payload ID: 16587
  Gene Symbol: STPG2
  Gene Name: sperm-tail PG-rich repeat containing 2
  Uniprot ID: Q8N412
  ENST ID: ENST00000295268
  CDS Start-End: 91-1470
cggcttcctttttctccacacttctagctaccttgtttttatcgttttcggcacctgcccttccccagcgcccccaccaccccgagcactatgtatgatcgggctccccgcctgctcaaattggctgaaggtggcagcactgaggcccatgtgggtcctggatcctaccaggtacctttcctgaagcagcaggcgacaggtagtaatgcaccatttctttctttgactgccagagaaagtacttttaccattgcctctagcattgagaaagctgttccaggtccaggacactataatgtttcagaagcacagaaaatttcaagatcacctacacttaccagaagtgttgatgttccttcaattccttcttgtggaaagtcatatggttatcatattaatgatgatggcagtattataaaatgttttccacctgcttgtgacagtacacttggtccagcatactacaaacctcaatttgatgtttccaatgcaactttgaaatacaaaggtatacattttggcaactcttcaggaagacaagagttacctaaaaagtcaggtcctggtccaggacagtatgatatagtccagaaaaagacatcatattatgaaaatgttaacatcaagagagatcaacaacaaaattattgttcatttatcccacgactatatgaaataatagtattgcaggagaaaaaaaagagatttttacctatgaaatcaatcaccccggctcctggcacatataatgaacctcgaactgctctcaagtctttgaagaaaacatcaggactgaaaaatattccatttggtcaaagtgctgttcgattcacacaggacatcaggacagaggaaatgccaggtcctggattttataatgtcttgaacaatactataattgccagtgttagaaatatctgctcaaagaaacagaagaaaagtgcatttggttcttctgttcctcggactttcttctcggttcagaaagaagcttgtgctacccctggacctgctgattatcaggaattttggcattcacagggtgtgggaatttctgatgaattacctaacttgactaacaaatatgctgctttcttgtcaagagccaaaagaactatgaaagtaccagatatggttattccagcgccaggcagctatgatgttcacaaatcatatgagatgtcccaagttaagcataaatatatgccacctcgtagtttagtggctaaaagaaaacatgcctcttttcttagtgcaactcctcggtgcctagaaaaagtgactgatgggccaggtcctgcagcatacaatcctgttttaaggaaatcttgccccatacccttatttgtgaaagcatcaaagcgctttgaagagtccaaagagattactccaggcccagcaacatatgagatatcccaggagaaaaagaaaggaaatctcattggtgaaatggctgctgatataatgtgacataaatttatggcaaaaacttaaaaaacaacttcatggaagtcagtttatttctttgtcattttaacaaaatttattccaaatataggagtaataaaagcataattttcacttgttcaggcattcgctcaggctttagtgactatatgacacaaccacggagaaataaaccttgttaagac

SEQ ID NO: 185810 - DNA, 4203 bp, Homo sapiens
  Payload ID: 16587
  Gene Symbol: STPG2
  Gene Name: sperm-tail PG-rich repeat containing 2
  ENST ID: ENST00000522676
  CDS Start-End: 1-561
ggttcttctgttcctcggactttcttctcggttcagaaagaagcttgtgctacccctggacctgctgattatcaggaattttggcattcacagggtgtgggaatttctgatgaattacctaacttgactaacaaatatgctgctttcttgtcaagagccaaaagaactatgaaagtaccagatatggttattccagcgccaggcagctatgatgttcacaaatcatatgagatgtcccaagttaagcataaatatatgccacctcgtagtttagtggctaaaagaaaacatgcctcttttcttagtgcaactcctcggtgcctagaaaaagtgactgatgggccaggtcctgcagcatacaatcctgttttaaggaaatcttgccccatacccttatttgtgaaagcatcaaagcgctttgaagagtccaaagagattactccaggcccagcaacatatgagatgaataatacagaggaaagcccacgtggactgaggacatactacatggagcatggaggtgataagaccatttcttcaggaatgaccagaatagcataaaagatcaatggaagcattgccaaaaaaggaagactgaaatctcaacctttcagggagtaatttatcatttggatgagcctaatgagaaaagcagtgcagtgaatgatgtgacaatatgaaacaacaaaatagtgaatgattaacgagtgacaaattgagagggaaaaaaaaggataacgctttcattatggtacaaaagagaatttgacaaactcatccaagaaagcaaccactttttcctccgtcttagttgaacgccttgaaaaacgaacaatcatactgctttcaaggaatttcataagagtaaaatagttaaacttctatagaatttcaataattaagggttacaaatatatttaaaggattttgaagctttaataatcaaaactttataaaaattatgctgcaattattcagggcaaatcaaaatgagaaaaaaccgtggcattttgataagtataaaagttataaaataaaacatattatttgttacaaatgacaatttaatgaaatatagttttgcattgaatctagctaggaaattttagatcatatgttttatggaattgatttgtattgtctgacatctaatttatagctggtcatgaattcaaattcttggcactgcttttttctaactatgtagcttgggaaaatatcttaagttttctaagtttcctaagattcaatttcctcatattctaacttgacctaacacactctatctgccaaaattattgtgaagaattaatgagctaatatctgggacagaaacaaaaaaatcaaagcctagtacctgtcacagaacacacatccacaatgtcattttcctcccattatgtcattagtctcaacaaaaagttaaaaatccaacctcatccaaaatccaatcaaaattaatcagaataagagaagttgggcaaattgatttccattaacttcaagtgcaaagtgttttgcacactcctgggatttacatgatggagaagaacagattcgaatgaactttgcctaacacaaattagataaatatccttttccttgaggacattaacatttagtaaacattaatgaaaaaaaaacaagtaatgcatgcctaatcatgtgctacatatgcctaatctgaattcatctttaaacggggaacggtttgaatggaaaattcatgttttgggttcctacttgtgacatgtaatgataataatttgtgtattccagtaaaattccatgccttttgaaatgtctctgtatgaatatgttgactaaaatgggtcattttagaaagacttatgaagtttgataactggaaaaagtcctaagaatggcctaatttatgtaaataatatacacaatgataatagaaatgtaactaatattagtttgttaataatgcttttatttctgaaaatacaaacaagtctgtagagtcacatgaacaatgggggaaatatttttctgactatgtctgtagaactttccaaaagtggaatctctaagttgcttttttttttttttttttttggtatggacttttaattaatgacacccttgtagaaaaatagaatttaaaaaaggggggtgggggactagggaaggggtagcattaggagaaatacctaatgtggatgacgagttaatgggtgcagcaagccaccatggcaggtgtataactatgtaacaaacctgcaggttctgcacatgtatcccagaactttaagtataataaataaagaaaaatatataagagattttaagacattaaatggccattttgaattaactcctaaaactaaaaatcaatgtcctcagcatttttaaaagaacaactatggcagaaaatgagaaacaaagtaagtggtggagtgagggatgaagatggggctgagtaatagggtgataaattgaaaggttttcagtatggatttgactgaatgacctggggcccaggtcacctgactcctaaccaaattattttccctgtaataaaagtttatattctaagcagagaaaatatggttggatggatggatgaatcgatagatggatggatggatggatggattatagatatgaaaatctttctgaattctattacatactttgtggagaaaattattttcagtattagttattcatctgggttgtaatagagtgagtcatttgagctgagttggaaaattttccttaaacataaattgccccagactgtcattttgttctcaatgtttcattctgcagtgtttggttctctcttgatgtcaaactgtcagaaatcatcctgtggtcagtacacctgccacagcagtcacttcttgtcttcccaggggaaacaggatagtatacttacagagaaaactgaatgaaccttggagttagacaaacctcagctataccctggatctcccattgtgggctagctactcaaactaaatgaagctctctatcttcacctgaaaaatgaggataacaggaagtgcctgttgtgtgaatcaagtaaacaaaattttaaaaatatgtaacagaattcctgaaacacatacatacagtcaatggaacttttctcctttctacattctcccatgctgttgaaggcatgcctttgttgttgttgtgttgttggagagtgctaatctagcttgataaggtgttatatgaaataatggtaaattggctgtgattggatgtctgagaagctcttcaatgtgtttacatttgactgttttggctgcctacatctaagtttttggctgttttctgaataattgagattttttgaacatgtgaaatgtcaccacagtgttgcaaaactctatattctttatgttcctgtgttaagataaaaatctcatgtgtcaaattgataacccgagttttcctacccatgtatgtcataagaaaatcactgaaaaaggtaaatatatcaattaagttatttatcatatagactataaattttcccagattgttggggttttttttttagtactttacctagcatacattttaatttagtcaaactggtttcatgtatattttactaaacatgcttcagacatggtaccagttcaatattctaatttaatttctatagattattaaaaatttttaaattataccagttttactgagttctgtttttaatacattttaggaattctgaaaaatagaattcccacagaaaggaatcctaagaaaattcatgtgaagaatgagatcttatttgggggattaattataatctggaagttttacttataacctcgtatttcatatatattataagatacttacattgaattatagaaatatacaaacaataattgaaaagcttaacttctgcctctgaagatatgattatctcatctcctggcctcttttgtgtttgttttaaggcaataaatacttgcttttctcctcctgatcatgagaaaatgatctttatttaatataaatttgatttatattttatcttttaaaattattattttggttatatctgctcaataatagaaaaaaattatggcttaactgatattgaattatttcaaatattacaacaagaaagcatacagaaatcacagtacagagatataaaatatgtaaaataaaaagtttaaaaagatttcaaatgtagcagaaaaa

SEQ ID NO: 185811 - DNA, 2269 bp, Homo sapiens
  Payload ID: 16588
  Gene Symbol: SPX
  Gene Name: spexin hormone
  Uniprot ID: Q9BT56
  ENST ID: ENST00000256969
  CDS Start-End: 167-517
aatcttgcttgaagactgacaagatgtccctgtggactcccaaactctactccagatggggaggtgcccttaacaccaagattttaaaagctccaatttcagagcaagagtcgaaaactcacagataaagttatagttatttcagggttctgaaaagacgcagaacatgaagggactcagaagtctggcagcaacaaccttggctcttttcctggtgtttgttttcctgggaaactccagctgcgctccgcagagactgttggagagaaggaactggactcctcaagctatgctctacctgaaaggggcacagggtcgccgcttcatctccgaccagagccggagaaaggacctctccgaccggccactgccggaaagacgaagcccaaatccccaactactaactattccggaggcagcaaccatcttactggcgtcccttcagaaatcaccagaagatgaagaaaaaaactttgatcaaaccagattcctggaagacagtctgcttaactggtgaaaatatactggattatgtttaattatggttctattctctttgaaaacatgaaccatgtgaataaaacctttggacccttttattccatttgtaatcttaagaacacacacagatagttttattctttcagaaacaaaatatatataggatgcttagctgagaacatcatcttctttcattgcttcaggtcctgtttagatgaccaaaaatgttttcagatcaccttgtgtcttactcttgagtttcttagaatatttataattataaggctgaagactaaagtgttctttccttttaactatagccagtacctgtcttgatcttagttgtgtttttttttcattttgttacccacttgcattttgttttcactcagcagaaattctccttctctgttttccttttatcccatccccaagaatgtggaaggaaggtgagaaacatggcaggatgggaaataggagagtatgactctctatagctcatccaggagtaatcaattaagaagataaattggatgactgtggagaagctctgtgataggaacacttcagtgtggttgctgagaggagacagtcattgaggtagaaggtttgccaaagatccagagctcagagctccctttgtgctctttgggaattaccttgcattcagtttagaaacatggatctaaaagttactgggaaataagcagatggagacacactctgttgtttacgtattggaagaagggaacaagccagttttgttagaggtaactcattttccatgaccaaacagactcaacagattcaagtactctgcttactctaattgactagactctaggttttatttgacatcatagcattacataaatcactctgataacataagtgcacagtaatatgcctgatctcttcctttttaaaagccaacttgagttcagtaccatctgaatacacacacatgcacatatacccacacacgcatacacacatactcctgtggcaaacataataatgtatttatttagaattataatatgaccatcatgttaattattttttacctaatcagagttgttattgacaaatgtcataagtggaaagtattaattcttattgtcatcagtatttagccattatttagtagctcaagaatatctttatgtgaatgtctctgtaacttggaattgcaatttcactgtgttaagtaatcagaactctgcttataagatttatctgtatcttgtttcataatttaataatgaaactaaattcaagttaatgtaatgttgatctccgtcgaaaaataacttgtgagcattaaaatatctgtatggcattataataggcacctgtcattaattatgatttgatttgaaagtagacttactaggtagtgcttacatctgatttattgaaaattttttccaaaagcattgtcttttatttatacagtcctaaccacttcaccattaggaggggtgggacattaaaaattatttacccatcagacataaaattgtacaaattgactattcaaaatagtatgtgtattcaaagaacacttttaacatctatcttatgaaataattcttcctacaactaaccagaacaatctcaaaaatgtcatactaaccattgttttaaaagctgtctcaatgatcaatagctgttaaaatatagctccaagtattctaagtactcaaattccttgaatgttcttatgtacaaatatgctgattaattaaaaggtccctcttcccaa

SEQ ID NO: 185812 - DNA, 554 bp, Homo sapiens
  Payload ID: 16588
  Gene Symbol: SPX
  Gene Name: spexin hormone
  ENST ID: ENST00000546199
  CDS Start-End: 41-151
atagagactgttggagagaaggaactggactcctcaagctatgctctacctgaaaggggcacagggtcgccgcttcatctccgaccagagccggagaaaggacctctccgaccggccactgccggacgaagcccaaatccccaactactaactattccggaggcagcaaccatcttactggcgtcccttcagaaatcaccagaagatgaagaaaaaaactttgatcaaaccagattcctggaagacagtctgcttaactggtgaaaatatactggattatgtttaattatggttctattctctttgaaaacatgaaccatgtgaataaaacctttggacccttttattccatttgtaatcttaagaacacacacagatagttttattctttcagaaacaaaatatatataggatgcttagctgagaacatcatcttctttcattgcttcaggtcctgtttagatgaccaaaaatgttttcagatcaccttgtgtcttactcttgagtttcttagaatatttataattataaggctgaagactaaagtgttcttt

SEQ ID NO: 185813 - DNA, 4707 bp, Homo sapiens
  Payload ID: 16589
  Gene Symbol: SCAPER
  Gene Name: S-phase cyclin A-associated protein in the ER
  Uniprot ID: Q9BY12
  ENST ID: ENST00000324767
  CDS Start-End: 60-4262
gagtcatactccatgggtttatgtgataaatgatcttggcatagaagagaatttaaagaatgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctagagacagggaagaacgattggcagcactcacagctgctcaacaagaagctatggaagagttacagaaaaaaattcagctcaagcatgatgaaagtattcgaaggcacatggaacagattgaacaaagaaaagaaaaagctgctgagctaagcagtgggcgacatgcaaatactgattatgcccccaaactgaccccttatgaaagaaagaagcagtgttctctctgcaatgtcctgatctcttcagaggtatatctttttagccatgttaaagggagaaaacaccagcaagccgtgagagagaataccagcatccaggggcgtgaactgtcagatgaagaagtggagcatctttccttgaagaagtacattattgacattgtggttgaaagtacagctccagcagaagctttgaaagatggagaagagcggcaaaaaaataaaaaaaaagccaaaaagataaaagcccggatgaacttcagggctaaggaatatgagagtttaatggaaaccaaaaattctggctctgattcaccttataaagcaaagcttcagcgattagccaaagatcttctaaaacaagtacaagttcaagacagtggctcatgggcaaacaataaagtgtctgctttggatcggaccctaggagagatcactagaatactggaaaaagagaatgtggcagatcagattgcatttcaagctgctggtggattaacagcccttgaacacatccttcaagcagtagtcccagccacaaatgtgaacacagttttaagaattcctcctaagtctctctgcaatgcaatcaatgtttacaacctcacctgcaataactgttcagaaaactgcagtgatgttctgtttagtaacaagattaccttcttaatggacctcctgatacaccagttgacggtttatgttccagatgaaaataatactattttggggagaaatacaaataaacaagtttttgaaggcttgacaactggacttctcaaagtcagtgctgtggttttgggctgcctgattgccaatcgaccagatggaaactgccagccagctaccccaaaaataccaacacaggaaatgaaaaacaaaccctcacaaggtgatccttttaacaatcgagttcaggaccttatcagctacgtggtgaacatgggtctgattgacaaactgtgtgcctgcttcctctcggtgcaaggcccagtggatgagaatcccaagatggccatatttctgcagcatgccgcaggactcttacatgcaatgtgtacactgtgctttgctgtcactggaaggtcatacagcatatttgacaataatcgccaggatcccacagggctgacagctgctcttcaggcaaccgacctggctggagttcttcatatgctctactgtgtcctcttccatggcaccatcttggaccccagcactgccagtcccaaggagaattacactcaaaataccatccaagtggccattcagagtttacgtttcttcaacagctttgcagctcttcatctgcctgcttttcagtctattgtaggggcagagggcttgtcccttgcattccggcacatggccagctccctgctgggccactgcagccaagtctcctgtgaaagcctccttcatgaggtcatcgtctgtgtgggctacttcactgtcaaccacccagataaccaggtgatcgtgcagtccggccgccaccccacagtgctgcagaagctctgccagttgcccttccagtatttcagtgacccacggctgatcaaagtactgttcccttcacttatcgctgcttgttacaacaaccatcagaacaagatcattctggagcaagagatgagctgtgttttactggccactttcattcaggatttggcacagactccaggtcaagcggaaaaccagccttaccaacccaaagggaaatgccttggttcccaagactatcttgagctggctaacagatttcctcagcaggcctgggaagaagctcgacagtttttcttgaaaaaagagaaaaaataaatgttttggttgattctgtatttgagtacccttgttaatattttaaattgtccaaacaaacattctaattgttccttaagaactcattttcccatgtttatactcttcccacactgtagatatggcatgtactttacactatttataatgactgtagatacttgaatgttctacttgctaattttgcaagttgagtttatttcatttatgcagagtatcttggagtttggtaatttccatcttatgataatatatactttgcatttgtgatatgggtgaaaggagacataaaattagcaagtctgttttgttcttgtaataaagtaacttattctgttttcattgttgacttttcatgttaaggaaatacgaatctgaaagaaaaatgttaactccagctcttgaagtatcttaaataaagacttaattaaagtttacctgctct

SEQ ID NO: 185814 - DNA, 4853 bp, Homo sapiens
  Payload ID: 16589
  Gene Symbol: SCAPER
  Gene Name: S-phase cyclin A-associated protein in the ER
  Uniprot ID: Q9BY12
  ENST ID: ENST00000538941
  CDS Start-End: 941-4405
acttctccttcctgctgccttgtaaagaaggcgccttgcttgcccttctccttccaccatgattgcaagtttcctgaggcctccccagccatgctgaactgaaaacctaaatgtcaaactggtggaaaatctaagaggaccattcaaggcactcataaaactactaaacagctctttgaggaatcgccatacttctttccataatggccgaactaatttacactcccagcaatagcgtagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgtgaccagcttccatcctgaagccacctaggggctgccagccacttgtcaactcattagcatacaaaaagacacatcattttgggaattccaaagattttaggagttgcatgccaggagacttgagatgaagaccaaatatatattttgcaatatcacagaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctagagacagggaagaacgattggcagcactcacagctgctcaacaagaagctatggaagagttacagaaaaaaattcagctcaagcatgatgaaagtattcgaaggcacatggaacagattgaacaaagaaaagaaaaagctgctgagctaagcagtgggcgacatgcaaatactgattatgcccccaaactgaccccttatgaaagaaagaagcagtgttctctctgcaatgtcctgatctcttcagaggtatatctttttagccatgttaaagggagaaaacaccagcaagccgtgagagagaataccagcatccaggggcgtgaactgtcagatgaagaagtggagcatctttccttgaagaagtacattattgacattgtggttgaaagtacagctccagcagaagctttgaaagatggagaagagcggcaaaaaaataaaaaaaaagccaaaaagataaaagcccggatgaacttcagggctaaggaatatgagagtttaatggaaaccaaaaattctggctctgattcaccttataaagcaaagcttcagcgattagccaaagatcttctaaaacaagtacaagttcaagacagtggctcatgggcaaacaataaagtgtctgctttggatcggaccctaggagagatcactagaatactggaaaaagagaatgtggcagatcagattgcatttcaagctgctggtggattaacagcccttgaacacatccttcaagcagtagtcccagccacaaatgtgaacacagttttaagaattcctcctaagtctctctgcaatgcaatcaatgtttacaacctcacctgcaataactgttcagaaaactgcagtgatgttctgtttagtaacaagattaccttcttaatggacctcctgatacaccagttgacggtttatgttccagatgaaaataatactattttggggagaaatacaaataaacaagtttttgaaggcttgacaactggacttctcaaagtcagtgctgtggttttgggctgcctgattgccaatcgaccagatggaaactgccagccagctaccccaaaaataccaacacaggaaatgaaaaacaaaccctcacaaggtgatccttttaacaatcgagttcaggaccttatcagctacgtggtgaacatgggtctgattgacaaactgtgtgcctgcttcctctcggtgcaaggcccagtggatgagaatcccaagatggccatatttctgcagcatgccgcaggactcttacatgcaatgtgtacactgtgctttgctgtcactggaaggtcatacagcatatttgacaataatcgccaggatcccacagggctgacagctgctcttcaggcaaccgacctggctggagttcttcatatgctctactgtgtcctcttccatggcaccatcttggaccccagcactgccagtcccaaggagaattacactcaaaataccatccaagtggccattcagagtttacgtttcttcaacagctttgcagctcttcatctgcctgcttttcagtctattgtaggggcagagggcttgtcccttgcattccggcacatggccagctccctgctgggccactgcagccaagtctcctgtgaaagcctccttcatgaggtcatcgtctgtgtgggctacttcactgtcaaccacccagataaccaggtgatcgtgcagtccggccgccaccccacagtgctgcagaagctctgccagttgcccttccagtatttcagtgacccacggctgatcaaagtactgttcccttcacttatcgctgcttgttacaacaaccatcagaacaagatcattctggagcaagagatgagctgtgttttactggccactttcattcaggatttggcacagactccaggtcaagcggaaaaccagccttaccaacccaaagggaaatgccttggttcccaagactatcttgagctggctaacagatttcctcagcaggcctgggaagaagctcgacagtttttcttgaaaaaagagaaaaaataaatgttttggttgattctgtatttgagtacccttgttaatattttaaattgtccaaacaaacattctaattgttccttaagaactcattttcccatgtttatactcttcccacactgtagatatggcatgtactttacactatttataatgactgtagatacttgaatgttctacttgctaattttgcaagttgagtttatttcatttatgcagagtatcttggagtttggtaatttccatcttatgataatatatactttgcatttgtgatatgggtgaaaggagacataaaattagcaagtctgttttgttcttgtaataaagtaacttattctgttttcattgttgacttttcatgttaaggaaatacgaatctgaaagaaaaatgttaactccagctcttgaagtatcttaaataaagacttaattaaagtttacctgctctaaa

SEQ ID NO: 185815 - DNA, 5028 bp, Homo sapiens
  Payload ID: 16589
  Gene Symbol: SCAPER
  Gene Name: S-phase cyclin A-associated protein in the ER
  Uniprot ID: Q9BY12
  ENST ID: ENST00000563290
  CDS Start-End: 97-4299
gctttgagccgccccgaactaagcagggcggtcgggggagtcatactccatgggtttatgtgataaatgatcttggcatagaagagaatttaaagaatgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctagagacagggaagaacgattggcagcactcacagctgctcaacaagaagctatggaagagttacagaaaaaaattcagctcaagcatgatgaaagtattcgaaggcacatggaacagattgaacaaagaaaagaaaaagctgctgagctaagcagtgggcgacatgcaaatactgattatgcccccaaactgaccccttatgaaagaaagaagcagtgttctctctgcaatgtcctgatctcttcagaggtatatctttttagccatgttaaagggagaaaacaccagcaagccgtgagagagaataccagcatccaggggcgtgaactgtcagatgaagaagtggagcatctttccttgaagaagtacattattgacattgtggttgaaagtacagctccagcagaagctttgaaagatggagaagagcggcaaaaaaataaaaaaaaagccaaaaagataaaagcccggatgaacttcagggctaaggaatatgagagtttaatggaaaccaaaaattctggctctgattcaccttataaagcaaagcttcagcgattagccaaagatcttctaaaacaagtacaagttcaagacagtggctcatgggcaaacaataaagtgtctgctttggatcggaccctaggagagatcactagaatactggaaaaagagaatgtggcagatcagattgcatttcaagctgctggtggattaacagcccttgaacacatccttcaagcagtagtcccagccacaaatgtgaacacagttttaagaattcctcctaagtctctctgcaatgcaatcaatgtttacaacctcacctgcaataactgttcagaaaactgcagtgatgttctgtttagtaacaagattaccttcttaatggacctcctgatacaccagttgacggtttatgttccagatgaaaataatactattttggggagaaatacaaataaacaagtttttgaaggcttgacaactggacttctcaaagtcagtgctgtggttttgggctgcctgattgccaatcgaccagatggaaactgccagccagctaccccaaaaataccaacacaggaaatgaaaaacaaaccctcacaaggtgatccttttaacaatcgagttcaggaccttatcagctacgtggtgaacatgggtctgattgacaaactgtgtgcctgcttcctctcggtgcaaggcccagtggatgagaatcccaagatggccatatttctgcagcatgccgcaggactcttacatgcaatgtgtacactgtgctttgctgtcactggaaggtcatacagcatatttgacaataatcgccaggatcccacagggctgacagctgctcttcaggcaaccgacctggctggagttcttcatatgctctactgtgtcctcttccatggcaccatcttggaccccagcactgccagtcccaaggagaattacactcaaaataccatccaagtggccattcagagtttacgtttcttcaacagctttgcagctcttcatctgcctgcttttcagtctattgtaggggcagagggcttgtcccttgcattccggcacatggccagctccctgctgggccactgcagccaagtctcctgtgaaagcctccttcatgaggtcatcgtctgtgtgggctacttcactgtcaaccacccagataaccaggtgatcgtgcagtccggccgccaccccacagtgctgcagaagctctgccagttgcccttccagtatttcagtgacccacggctgatcaaagtactgttcccttcacttatcgctgcttgttacaacaaccatcagaacaagatcattctggagcaagagatgagctgtgttttactggccactttcattcaggatttggcacagactccaggtcaagcggaaaaccagccttaccaacccaaagggaaatgccttggttcccaagactatcttgagctggctaacagatttcctcagcaggcctgggaagaagctcgacagtttttcttgaaaaaagagaaaaaataaatgttttggttgattctgtatttgagtacccttgttaatattttaaattgtccaaacaaacattctaattgttccttaagaactcattttcccatgtttatactcttcccacactgtagatatggcatgtactttacactatttataatgactgtagatacttgaatgttctacttgctaattttgcaagttgagtttatttcatttatgcagagtatcttggagtttggtaatttccatcttatgataatatatactttgcatttgtgatatgggtgaaaggagacataaaattagcaagtctgttttgttcttgtaataaagtaacttattctgttttcattgttgacttttcatgttaaggaaatacgaatctgaaagaaaaatgttaactccagctcttgaagtatcttaaataaagacttaattaaagtttacctgctctaaatttaactttttaaggtctacggtaaagatatttgcaacacttttgcattctgactacataatatgtttgggggctatttgaaatcaacttagggcgttgtattcattggtctgcccgaactctcctagcagataatcctctcttggcattgccgagctgaaattactctcctaaggaaaaattagtgataaaaaagatgtgtcctagtgaatcaccctagagtattttctcacatggttgtgaaatgaagcaacgctgaaataaaagtcacacagaaagtc

SEQ ID NO: 185816 - DNA, 641 bp, Homo sapiens
  Payload ID: 16589
  Gene Symbol: SCAPER
  Gene Name: S-phase cyclin A-associated protein in the ER
  ENST ID: ENST00000563919
  CDS Start-End: 307-641
cccgccccgtcacgcccctttcccggcgggacgctttgagccgccccgaactaagcagggcggtcggggctctgcccaggaaacggggcaggaatggcctctccgtcttccagatgcgtgcgctgaggcctggaggggcgaagagcctctcgcacctgggagtagtgggacccagcctcctgcctctgttgctgctcttttccaaaacagcacttccttggcgcctttcctctacaccgttttccaggagtcatactccatgggtttatgtgataaatgatcttggcatagaagagaatttaaagaatgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccg

SEQ ID NO: 185817 - DNA, 2388 bp, Homo sapiens
  Payload ID: 16589
  Gene Symbol: SCAPER
  Gene Name: S-phase cyclin A-associated protein in the ER
  ENST ID: ENST00000565970
  CDS Start-End: 147-2388
gtgcgtagcgcagacccgggcgggtccgggttggggcgcgggccgtctgaatgccttgcggggaccaggggacaaaatggcggcggggagtcatactccatgggtttatgtgataaatgatcttggcatagaagagaatttaaagaatgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaatgtgagtgctgctaacttgtccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctagagacagggaagaacgattggcagcactcacagctgctcaacaagaagctatggaagagt

SEQ ID NO: 185818 - DNA, 2627 bp, Homo sapiens
  Payload ID: 16589
  Gene Symbol: SCAPER
  Gene Name: S-phase cyclin A-associated protein in the ER
  ENST ID: ENST00000565507
  CDS Start-End: 277-504
acgctttgagccgccccgaactaagcagggcggtcggggctctgcccaggaaacggggcaggaatggcctctccgtcttccagatgcgtgcgctgaggcctggaggggcgaagagcctctcgcacctgggagtagtgggacccagcctcctgcctctgttgctgctcttttccaaaacagcacttccttggcgcctttcctctacaccgttttccaggagtcatactccatgggtttatgtgataaatgatcttggcatagaagagaatttaaagaatgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagctctttgaggaatcgccatacttctttccataatggccgaactaatttacactcccagcaatagcgtagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctagagacagggaagaacgattggcagcactcacagctgctcaacaagaagctatggaagagttacagaaaaaaattcagctcaagcatgatgaaagtattcgaaggcacatggaacagattg

SEQ ID NO: 185819 - DNA, 572 bp, Homo sapiens
  Payload ID: 16589
  Gene Symbol: SCAPER
  Gene Name: S-phase cyclin A-associated protein in the ER
  ENST ID: ENST00000565372
  CDS Start-End: 111-572
tttcccggcgggacgctttgagccgccccgaactaagcagggcggtcgggggagtcatactccatgggtttatgtgataaatgatcttggcatagaagagaatttaaagaatgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtc

SEQ ID NO: 185820 - DNA, 544 bp, Homo sapiens
  Payload ID: 16589
  Gene Symbol: SCAPER
  Gene Name: S-phase cyclin A-associated protein in the ER
  ENST ID: ENST00000568382
  CDS Start-End: 199-544
cctttcccggcgggacgctttgagccgccccgaactaagcagggcggtcgggggagtcatactccatgggtttatgtgataaatgatcttggcatagaagagaatttaaagaatgatggaaaacctaaatgtcaaactggtggaaaatctaagaggaccattcaaggcactcataaaactactaaacaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacag

SEQ ID NO: 185821 - DNA, 2507 bp, Homo sapiens
  Payload ID: 16589
  Gene Symbol: SCAPER
  Gene Name: S-phase cyclin A-associated protein in the ER
  ENST ID: ENST00000564590
  CDS Start-End: 206-2507
agccgggagcggcgcggcagcggctgagatcacgtggtgcgccgggaagccaccccgcctctccgaggcctccctgccccgccccgtcacgcccctttcccggcgggacgctttgagccgccccgaactaagcagggcggtcgggggagtcatactccatgggtttatgtgataaatgatcttggcatagaagagaatttaaagaatgatggcttcattccagcgctccaatagtcatgacaaagtaaggagaatagttgcagaggagggtcgtacagcaagaaacctaatagcttggagtgttccactagaaagcaaagatgatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatcaaatgctcgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatgaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaatgtgagtgctgctaacttgtccatggcagaagtccttgctaaaaaagaagagctagcagatcgtctagaaaaggccaatgaagaagccattgctagtgctattgctgaagaagaacagttaactagagaaattgaagctgaagaaaacaatgatattaacattgaaactgacaacgacagtgatttttctgccagcatgggcagtgggagtgtttctttctgtggtatgtccatggactggaacgatgtccttgcagattatgaagctcgtgagtcttggcgccaaaatacatcctggggggacattgtagaagaagaacctgctagacctccagggcatggaattcacatgcatgaaaaactttcttcaccctctcgtaaaagaacaattgcagaatctaagaagaaacatgaagaaaaacaaatgaaagcacagcagctaagggaaaagttacgcgaagagaaaacattgaagcttcagaaattgttagaaagggagaaggatgtccggaagtggaaggaagaattgctagatcaacgacgcaggatgatggaagaaaaattacttcatgctgagtttaagcgagaagtgcagttacaagcaattgtgaaaaaagcacaagaagaagaagctaaggtaaatgaaattgcctttataaatacccttgaagcccagaataaacgtcatgatgttttatcaaaattgaaggaatatgaacagaggcttaatgagctacaggaagagcgtcagagaagacaggaagaaaagcaagcacgtgatgaagctgtgcaggaacgcaagagagctctagaggcagagcggcaggcccgtgtagaagaattgttaatgaagaggaaagaacaagaagcccgaattgaacaacagaggcaagaaaaggaaaaagcccgtgaggatgcagcccgggaaagagctagagacagggaagaacgattggcagcactcacagctgctcaacaagaagctatggaagagttacagaaaaaaattcagctcaagcatgatgaaagtattcgaaggcacatggaacagattg

SEQ ID NO: 185822 - DNA, 574 bp, Homo sapiens
  Payload ID: 16589
  Gene Symbol: SCAPER
  Gene Name: S-phase cyclin A-associated protein in the ER
  ENST ID: ENST00000564022
  CDS Start-End: 1-574
tctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagaatttcctccaggatccagtgtggaattactcagttcatttgttcacagtgagtacattggatgatgtgaagaattctggcagtattcgagacaattatgttcgaacttctgaaatatctgctgtccacattgatacagagtgtgtttcagttatgctgcaagctggtacacctcctttacaagtaaatgaagaaaaatttccagcagagaaagcaaggatagaaaatgaaatggacccttcagatatttcaaattccatggcagaagtccttgctaaaaaagaagagctagcagatcgtctagaaaaggccaatgaagaagccattgctagtgctattgctgaagaagaacagttaactagag

SEQ ID NO: 185823 - DNA, 626 bp, Homo sapiens
  Payload ID: 16589
  Gene Symbol: SCAPER
  Gene Name: S-phase cyclin A-associated protein in the ER
  ENST ID: ENST00000564757
  CDS Start-End: 1-298
cttcagggctaaggaatatgagagtttaatggaaaccaaaaattctggctctgattcaccttataaagcaaagcttcagcgattagccaaagatcttctaaaacaagtacaagttcaagacagtggctcatgggcaaacaataaagtgtctgctttggatcggaccctaggagagatcactagaatactggaaaaagaggtatatactgtatggaaagcaatgcatatatccaccaggcaagatatacacaaatgttcaatggcagcattgtttataatcaccacatatggaaaatagtgcaagaatccatcaacagctggagatacaaattatgaatgtggcagatcagattgcatttcaagctgctggtggattaacagcccttgaacacatccttcaagcagtagtcccagccacaaatgtgaacacagttttaagaattcctcctaagtctctctgcaatgcaatcaatgtttacaacctcacctgcaataactgttcagaaaactgcagtgatgttctgtttagtaacaagattaccttcttaatggacctcctgatacaccagttgacggtttatgttccagatgaaaataatactattttggggagaaatacaaataaa

SEQ ID NO: 185824 - DNA, 576 bp, Homo sapiens
  Payload ID: 16589
  Gene Symbol: SCAPER
  Gene Name: S-phase cyclin A-associated protein in the ER
  ENST ID: ENST00000564177
  CDS Start-End: 395-576
tttcccggcgggacgctttgagccgccccgaactaagcagggcggtcgggggagtcatactccatgggtttatgtgataaatgatcttggcatagaagagaatttaaagaatgatggaaaacctaaatgtcaaactggtggaaaatctaagaggaccattcaaggcactcataaaactactaaacagagtactgcagtggactgtaaaataacatcgtctacgactggagataaacactttgataaaagtcccactaaaacaaggcaccctcggaaaattgatctaagagctcgatactgggcatttctttttgataatcttcgccgagcagtagatgaaatctatgtaacttgcgaatcagatcagagtgtggtcgaatgtaaggaggtgctaatgatgctggataactatgtaagagatttcaaagcattgattgactggattcagcttcaggaaaagctagagaagacagatgctcaaagcagaccaacatcattggcatgggaagtaaagaagatgtctccgggacgccatgtgattccaagtccatcaacagatagaataaatgtaacatc

SEQ ID NO: 185825 - DNA, 625 bp, Homo sapiens
  Payload ID: 16589
  Gene Symbol: SCAPER
  Gene Name: S-phase cyclin A-associated protein in the ER
  ENST ID: ENST00000568549
  CDS Start-End: 1-189
cgacgaagcttaaattttggaggttcaactggcacagtgccagctcctcgtctggctcccacaggtgtcagttgggctgacaaggtaaaggctcatcatacaggctctactgcttcttcagaaataacacccgcccagtcttgcccaccaatgacagtgcagaaggcctcacgcaaaaatggcaagtgacttcgaattagccattttgtgtagtaaacagaacggaaagatgctgaaggatgggagaccgttcagagaggaaggcctattcgttctcgatcaacagcagtgatgccaaaagtttcattggcaacagaagccacaagatcaaaggatgacagtgataaagaaaatgtatgtcttttacctgatgaaagcatacagaaaggtcaatttgttggagatggaacttctaatactatagaatctcatcccaaagactcattacactcttgtgaccatcctcttgccgaaaaaacccagttcacagtgagtacattggatgatgtgaagaattctggcagtattcgagacaattatgttcgaacttctgaaatatctgctgtccacattgatacagagtgtgtttcagttatgctgcaagctggtacacctcctttacaag

SEQ ID NO: 185826 - DNA, 9474 bp, Homo sapiens
  Payload ID: 16590
  Gene Symbol: SKP1
  Gene Name: S-phase kinase-associated protein 1
  Uniprot ID: P63208
  ENST ID: ENST00000353411
  CDS Start-End: 185-676
agcccagccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaatattatctttattcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatgtgggatgtcatctttttataattagtgttcccatgtggagaaaattattcacactacttgcatgtaaagaataatttaacttttaacattaaaatatgtggtaaaacccagaaagcatccatcatgaatgcaagatactttcaataaaaagtaagttatatagtaggtagttaagtttgcttttgtggacttaaatgtgtctcttcacttaaatgggttgaatgtgtatatatttgttcagcttgaaaagacttagtttatatcctagctcactggaggctgctgacataaccataacttctgtcccttctaattgtcatttatatgcctaactggagctagtactttaattcttaacacaaaattactctgccattgtttccagcttccctcctacaatagaatgaagtttttttgatggcttgagatggctcacaaattttgatttttttttcttccttgtgctccctttttttctccttgcttttccagttaacatctatattcacatgtaatcttgttttctcttcacattcactgagttgttcaggctcagatcatcccttgacagtagtttgccttcatctcacctttcatttgtcccaaattcaccttatttaataaagtcccatatgttgtctcacttaattccaatttgttgtctgtaccagagataggaaactataatgtgtgggtcaaatcaggcccatagcctgtttttgtagtctttgagctaaaaatggtttttacgttgtaaagagttatttaaaattctctctctctctctctctctctctcaggagataagcttgttttctgtttgtcctggttttagtggggaaggtagcggtgtatagtcctagctgaattgtctcatctaccaattcctgctattataagatcaacttctgcaaaaaccttatccacctcaagtatccttagcagctgggcatggtggcttatgcctgtaatctcaacattttgggaggacaagacaggaggatcgtttgagcccaggagttcaagaccagcctgggcaacacagaaagtccctgtctctccaaaaaaaaaaaaaaaaattagcagtcatatggtgcatgcctataatcccaactacttgagaggctgaggtgggaagatggcttgagcctgagaggtcgaggctgcagtgagctggcattgcaccactgcactccagtctaggcaatagagcgagaccttgtctcaaaaacaaaccagaagtatccttagcagtattatgacaaacaaatcttcactgaaggtccaggattactgccatatgccatgtttaacttgtaaaggaagtatcaccttctaagaaactggagcttgttattaccacttgatctgtataatactcagcagtagttagaattatatgagtaaataacgtcactatccgtatttaaaggataatgagatctttcagaaagattggatggacagacaatatagtagtaatttaaatttttgtttcctgactttctgtagtccctaaacaaacaacaaaaaatcctagtaatcttaaacttttacattaatagagatccaagagaaaataagccatttttcaccattgtggacccaaataaatcatagacatggtattaagaagcccttttcagtctggttgcagtattattttcctacctttctttttcctgttccctgctgtatgcccactattcctttaatatatctactagaacttttctaggctttcacctggagtgagtggtcctttctcattatcacagtagccaaacctcagtcttcaaaactccactcatttctggctactctcttacttcccaactattcttctaaactaatattgtggcattaagtcataccttgaggctggagttttagtgtcttcatggccttgggcaagttggaaataggtactacggttttatagatctagtgcagtctgctttatattagttccagaacttcattggaagtcacttgacagcaggatttaacttgtatttagcagcactactccatgaatttcagtataagtaacagaagtgaaaagtccttgtgaaatgcaggtacagggcataatgaaaacaagaagagtagttttaatgcatgagaggggagagcttgataatagctgataatagccttggtttggagagtggttactgatgaattatgaagactttctctaattactgttatagtagtaaaggaaagaaaacccttgttgataaagtaaacttagggattaattaggaaatgccttttatttcaccaggaaagagaatgagaggaagaaggtatttggcagatttgggtgattgaaggatgtttgtcggtttcctctgtaaacaacatgctgctttctgcagtgtgctgcttttaatgatgaagtcctttcaaggactccatggcagtcctttggcttctcaccttttcattgattatgtcacttgtgatctaaaagtaaaccaaaaccttcctgaatgttagcttattattttctccttaacattgtcataggctaaagatgtgccccctcaaattctaataatttttttttttttttttttttttttgagacagagtctcactctgtcgcccagactggaatgcagtggtgcgatctcagctcactgcaacctccgcctcctgggttcaagtgattctcctgcctcagcctcccgagtagctgggattacaggcacatgccaccatgcctggctaatttttttgtgtttttattagagatggagttttaccatattggccaggctggtcttgaactcctgaccttgtgatccgcccgccttagcctccgaaagtgctgaggttacacgtgtgacccaccgcacacggccctaataattcttaagttgtagaagcaagttactcttttgaagtgccatgtgttagcttgccttaatctattcttggtatacaaaatagatactgctttacagttcttatattttctcagagattcacaaaatcatcctgtagctccctgtgtgggattatagctgtgactttttactctacaactgtcagaatacaccagctcctggaattaagcaagaactatattgtgacttggttggacaggtaactgcagccttgtaacatgacatcatagtaatgctgagcttatcttaaaactagctggggagggaggatagtaacagtgagtcactgtgggcatctcacttagggcaggcagatattccaaatcacattgatttttcagtttacgtaaaaattgaccaatcctatgggctgtgttctgatcccaacataaattttgtttaagttaatttgcctaggctctcaataaggcagtttgggaatataaggtgattttccaccagaaaagagaaaattgagagagcagcagacctcttgctctcagcaccctttacaagcttaacttttgcttgccaccattagcttttgaagattttttttaactgctccttgcagagcaggactaccccataggcagtgtgcccagagtagcccgaagagctttttgattcttcttttaagagacaaggtctcacctctgccccccaggctggagtgcagtgatgtgatcacagctcattgcagcctcgaactcttgggctccaacagtcctcctgcctcagcctcctgaatagctaggactacatgtgtgtgctaccatgccttgctagtttttgtttttttaaattgatttttatagagatgaggtctcctcatgttgcccaggctgttttcgaattcctgggctcaagatcctcctgcctcaacctcccaaagtgctggtattacagatgtgagccacagcacccaccaatttttccttttctaaagctcagtgtacattctggtaggaaggaatcaaccaagtaaatgttctccctacaaagttgtttgaggatttgaaaagttaatcttcaattatctggatttgaaaccagtctataactttttaagctaggaagaagtcaagaataagaagattgcaagcaaagggaaagcttacaaaatggctgaatccttaaagtgtagctcctggcttctccttggtaggaagcattagacatggtttccctctagggagctgggagcttttggtgtagttcaggagagaaggcataaatactgctgggagggagtggataactctaataaaaatgttcctgggctgggcacggtggctcacgcctgtaatcccaacattttcagaggctgaggtgtgcagatcacgaggtcaagagatcgagaccatcctggccaacatggtgaaacctcatctctactaaaaatacaaaaattagctgggcgtggtggcacatgcctgtagtcccagcaactcgggaggctgaggcaggagaaccgcttgaacccgggaggcggaagttgcagtgagccgacatcacgccactgactgcagtccagcctggcgacagagcgagactccgtttcaaaaaaaaaaagtttctggacagaacagattaatgagccaatggggggctacagagctgaaaggtgctacgaaaggttttgtaaagtgaaactaatttggtttcaagaatcaagttggatttgtttgggggtggacagatgccaaagtgaggaaaaagcagtgcacagtcaggaactaacagcagaaggttgggtgttggtacatttccctgagaatatagactaaagagaaattagggcaggattagtcacagtactttgctgacactcagtagtattttatcagcatttattcatcagacccacattaggcagggcaatttttgagtgagctaaattctaatttttttaattttaatttttatttatttattttttggctgttcaactaaaccagtcttttgaatgttgggggttttacagttagagtcctgatgactttttcttgtttactgttgttaaaaatcactacctccagtggtcacagagaatgagtaagagaactggctgtgcatatcaagatgaagtatggtgtaagaaatatttcagagcatgtcctttggcccaagattgagccatttggacacctaagcaggattggctgaatgttatcctttctgctgaggcatcagtggagatgatcattagtggtggccgaaaagtgttgtcgaaggtgctcttgcttgacacacttccaatgcgggacatagtttgagtgatagatggctaattcattgataatgtacttgttgccttgcagtcttgtgtactgctggctacctctggtctgtgtgccagtattgagcagcattctatgggaggaatgtagttgctcataacagtgtctgcttccacatctgtagttcttgcgaccttctgatatctgtcaactttaaattttctggaagtatttaagtatattcagaccttctgatatctcttaacttcaaattttcaacctgctatatagcagcctcttattgcacactgaggatcagcttatttccttaaagtgctctcactttgaatacctcccacctatctggtgaaaattcttatttgtcctttctttcctgaatgtaccatttcacaacctctaactgccttcttcagttgctttgcagatttttctgttccaggaagcttacggaaaggggtgggaaaatagagaagctgtactctatcctcaagtactcaagcagggtttccagagtggctttgtaaaaatttttatttatttatttatttatttttggtgagtggaacctggcttttcctcttccctccccaagccccaccccgcttcctgacattgcacatgcctgaaagaactaggcttcagataaaagaatgagaacacttgaatgaaaaaggaagacttggtccagagcccctggtgaatatgaaagaagtattggcctggactatctcccgcataattcacagctgctatcttgtcttcagaagtgaaacatcccttaccaatagtgacctaacttgtgaggactgcttgtgatagtatagttcccacccccaggacataagttttccctttccagttaacatgcctaatcccatgctatctttaagagcttgaaaatccttcctgacctgagctaggcttttattctaagggactgtgtatgtgaacatccccaccatctatgtttcctgttttcaaactcggtgccgttttgagtattttcagatgctcactgccagtaatggtttgttagtagctccaaactattagagaagagctcaggagtcagaatttgaaagatgcccatagggtgatttgagatttggaacaaggttatcacaataagttgggattgggggagttgacacaaccagggtctgcttgggtgggcagctgtttcagaaacccttggtgaactcttaaagccctgaagagcttaaaaaatgctctgaagagatctgagagtcgcagttaaggactctcaaagaacctcaaagaaaagccaacttagcctttttatacaattaactagatttgggtcttaaattctactttgacatataggcctaagaggtagtttaacatggccttgttacccttaccccttctgttctgtgctgttttctgagaaacggatgcaggaactgattccctttcttcctctctggaacaggatataaagaacccttccgcttccctttacttgtggccttcctggccaggcttatgtatactgaacaaagctagggtgcagtgcttctgagctagctgttaggggtccacagccagaaggaatgggagaccacaggagccattcaaaagataattacatgtcagaagagagtccatccatggggttctgttaaagtagacaccttcacgttgggagacataggctttgtctgcttgctgggctgaaccctcaccatatccacagagaacaaaatggggagcagctgtaccaggggagggatgaacgtctttcacccaagttgccagtctgctagttgtctggaaatgttcaagggaggctaaggtatcttgtcttatgatgtctcaggaaacagggttggttctcagctggcagtgaagggggactggtgtggtattagcagttgaacttgaggttgcaatctcaagtcaccctctggcctcgcaggaatgcaccagggtgatttgggaggatctgagtttcctttatgaagtcagattaaaaaaaaaaaaagctgatctgatttaaacagagttgccaaagacttccccgccaatacacaaagactgcattgttcaggtaccctgtgtactctaagtgagacaccaaatcagatgcagcaacctggtcttgcataagccctggttagaatgtaggttttttaaacaactaggccagtagccagaacagaattctttaaaatgggacagatgtccagagaatggctagtgtcctctagcactctctcagaagcaaaagcaagtctggggttacaacttccagtggcctactttaaatagacgctgttctggaaaatgactttatactttaaacacaaaatccaaaaaatagaactcagtggagtgacaatgacaatgcatgatggtggcccagtggctgtcccatgtgaaatacttcttgcctgacatgtatcatctacttgttgactgacctattgaggtgccttcatgacaccttttacattcatgataggtctcaggaagacagcagtgtacttggtggaaactcatgtaaaaagtgggttgtagggagctaaacagtgagtacacatggtatatggatacggaatggaataatagacattggagacttcaaaaggtgggagatgaaagggggatgaggtatgaaatcctacctgttgagtacaatgtacactacttacgtgcacagtacactgtttgggtgagaggcacactaaaagcccggacctcaccgctacccagtatgttcatgtaacacagctgcacttgtaccccctaaatgtatacaaataatctaaaaatagcccggacctcaccgctacacaatatattcatgtaacacagctgcatttgtaccccctaaatgtatacaaataatctaaaaataaagtggatatggtggctgtcgtgtccaccaacagcgta

SEQ ID NO: 185827 - DNA, 572 bp, Homo sapiens
  Payload ID: 16590
  Gene Symbol: SKP1
  Gene Name: S-phase kinase-associated protein 1
  ENST ID: ENST00000328392
  CDS Start-End: 97-572
gctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccagcagggcagaataaaaaccat

SEQ ID NO: 185828 - DNA, 748 bp, Homo sapiens
  Payload ID: 16590
  Gene Symbol: SKP1
  Gene Name: S-phase kinase-associated protein 1
  ENST ID: ENST00000523359
  CDS Start-End: 693-748
ctgcattgttagatttgtgattctgcactgttcatttcagtactatctaatataaaaattacatgtttaaatgttttataattaaaaattgggctcaggttaaaatattttcttttggagataccttttgttgtggtcttgtcacaggaagggtcctctactctgcatccttctccattaagcagggacaactgcattattggcaagcgctaagcaacatggagaagcagacatgtttgtgaatcgcaaagtgaaatctgattctctccaactatggatgagtgagagtaggatatttcagtggctggttttaaaacatgctttacttttttgcttcctttgcctaacaacctgtttgctttggggttggcgacaattgtctcagagaagctgaatgaatattttaaccgatgtaatgggtcataagtctttgaacataaaatgggtgtgatgcatgttttaaatgccaaatgatacacttttgggaaaatatatgcgatttgtaatacaacacacctagaaaacttcagaggtgccataagttaatagtgacatcaccggattatgaatacttgagaagcatgggccttttaaaagttgtatgtgagttttaagaggccttgaattaatctgtaccagacataaatgagcatattctgatgtactctttggatctgaactcatcttcacagatgccttcaattaagttgcagagttctgatggagagatatttgaagttgatgtgga

SEQ ID NO: 185829 - DNA, 692 bp, Homo sapiens
  Payload ID: 16590
  Gene Symbol: SKP1
  Gene Name: S-phase kinase-associated protein 1
  ENST ID: ENST00000519321
  CDS Start-End: 266-692
gctgtagtggcttcgtcttcggtttttctcttccttcgctaacgcctcccggctctcgtcagcctcccgccggccgtctccttaacaccgaacaccgtgagtagccgcccactgaactggaaagggtcgtggctaccggattgcgtgccggctggcctcaccgctgcggtttgggcctgcccgcggcgggcggtgactgggcctggccttctttcgggcccggtggatcgcgttgtcgaccctgttcttcgggagaccctaccagatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaa

SEQ ID NO: 185830 - DNA, 1683 bp, Homo sapiens
  Payload ID: 16590
  Gene Symbol: SKP1
  Gene Name: S-phase kinase-associated protein 1
  Uniprot ID: P63208
  ENST ID: ENST00000522552
  CDS Start-End: 111-593
cgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtaggtagcacacagttttgtctttgatcacatgctcttaaaaagggagtaacacctataacatgccagcaaaagaggtgactgtatcaagtagtcttgatactttagggataatatgtacttaatgtgtcttaaacatactcttactgttctgtctttatgaatctgaacacttagatgatactgcattttaagcataagaacaattagttttcaatgagaagagctcttgttaatgtattaacagttactagttttggcacctgcaactttctgtatagaccatacatatctgacatcagaaaagcaggccctagagagaagtatatactagggtactttagagcaacttaatgaggggaggaaatgaaagaatagatcagaatgattttgttgacatgactacagactgaaataatgtgaatgaattaactgaatttgctctgtcaactttagtaaattgcccattgcctttgctttgttcataatttcagcagggcagaataaaaaccatgggaggcaaagaaaggaaatccggaaatatagtcttaacctggtgttgttctaattttccatctgttcttctgactcaactcactggctatcgatgaatcagtaggtagtatttataagtcttaggaaagactactcaagttaaggtacttccctatatccatctcttttaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttggcattgtaaataaaacaacttgcaaaaaagttttctggaatagaattaacaaaa

SEQ ID NO: 185831 - DNA, 802 bp, Homo sapiens
  Payload ID: 16590
  Gene Symbol: SKP1
  Gene Name: S-phase kinase-associated protein 1
  Uniprot ID: P63208
  ENST ID: ENST00000522855
  CDS Start-End: 150-641
gctgtagtggcttcgtcttcggtttttctcttccttcgctaacgcctcccggctctcgtcagcctcccgccggccgtctccttaacaccgaacaccacataaatgagcatattctgatgtactctttggatctgaactcatcttcacagatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcaca

SEQ ID NO: 185832 - DNA, 876 bp, Homo sapiens
  Payload ID: 16590
  Gene Symbol: SKP1
  Gene Name: S-phase kinase-associated protein 1
  Uniprot ID: P63208
  ENST ID: ENST00000517625
  CDS Start-End: 160-651
gttgtcgaccctgttcttcgggagaccctaccaggttccgttcacctgccccgcccccgactcagcgaggcctcctctggccgggcgtcctcacggcgctccataaacataaatgagcatattctgatgtactctttggatctgaactcatcttcacagatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctg

SEQ ID NO: 185833 - DNA, 899 bp, Homo sapiens
  Payload ID: 16590
  Gene Symbol: SKP1
  Gene Name: S-phase kinase-associated protein 1
  ENST ID: ENST00000523966
  CDS Start-End: 97-222
gctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagtcactgttcatcaagtacctattgaatgaagagtatgttgtgctcactaaaaaaaactgaaagcaatccaagtgtccctaaaaggcagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctc

SEQ ID NO: 185834 - DNA, 610 bp, Homo sapiens
  Payload ID: 16590
  Gene Symbol: SKP1
  Gene Name: S-phase kinase-associated protein 1
  ENST ID: ENST00000520417
  CDS Start-End: 305-610
tgtaagattatatctttttcctaacgactcataattaatctgaattaataaatgcgttttcagagcaagtaataggttattattatggagatcttgccaagagatctcaaagttggtcacctggacagtcagtactgaaagataaaaagggctctgaaatgaagcttttaagtagatttagggaattgtactcacatctgcttatctttaaatcattttattctcttgtatatggtcttgcattgcctcagacataaatgagcatattctgatgtactctttggatctgaactcatcttcacagatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaa

SEQ ID NO: 185835 - DNA, 654 bp, Homo sapiens
  Payload ID: 16590
  Gene Symbol: SKP1
  Gene Name: S-phase kinase-associated protein 1
  ENST ID: ENST00000519054
  CDS Start-End: 158-277
gctgcgacgctgtagtggcttcgtcttcggtttttctcttccttcgctaacgcctcccggctctcgtcagcctcccgccggccgtctccttaacaccgaacaccacataaatgagcatattctgatgtactctttggatctgaactcatcttcacagatgccttcaattaagttgcagagttctgatggagagatatttgaagttgatgtggaaattgccaaacaatctgtgactattaagaccatgttggaaggtcatcctttctgcattgtctgaattagtgagggtcgttctctcattaaatggataaaatcataagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatga

SEQ ID NO: 185836 - DNA, 899 bp, Homo sapiens
  Payload ID: 16590
  Gene Symbol: SKP1
  Gene Name: S-phase kinase-associated protein 1
  ENST ID: ENST00000521216
  CDS Start-End: 67-558
ttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaatatactttaaggaaaacaactgtctctttacaggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagtttgagcacagatcccaaaccttacggccaagtttcttctagtatgatggaaagtttcttttttctttgctctgaataaaactgaactgtgggttctctataagtggcattttgggctttccctcttttttgtaaagcaatgtctgcctagtttattgtccagttaactttagtgaccttttaaaagttg

SEQ ID NO: 185837 - DNA, 1537 bp, Homo sapiens
  Payload ID: 16591
  Gene Symbol: SKP2
  Gene Name: S-phase kinase-associated protein 2, E3 ubiquitin protein ligase
  Uniprot ID: Q13309
  ENST ID: ENST00000274254
  CDS Start-End: 275-1507
aagggaaggaagtaagggcgagcccgtcggactacgaagcgggacggaaactacaattcccagcaggccttgggcctcagtgcggccgcgaagcagagcgggctgtagagccttgcgcgcgcagtggggatggaacgttgctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtgtttcatgggactcccttccggatgagctgctcttgggaatcttttcctgtctgtgcctccctgagctgctaaaggtctctggtgtttgtaagaggtggtatcgcctagcgtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagcccttttcgtgtacagcacatggacctatcgaactcagttatagaagtgtccaccctccacggcatactgtctcagtgttccaagttgcagaatctaagcctggaaggcctgcggctttcggatcccattgtcaatactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttactattagtgacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttataaaaatgagtgcttaaa

SEQ ID NO: 185838 - DNA, 3759 bp, Homo sapiens
  Payload ID: 16591
  Gene Symbol: SKP2
  Gene Name: S-phase kinase-associated protein 2, E3 ubiquitin protein ligase
  Uniprot ID: Q13309
  ENST ID: ENST00000274255
  CDS Start-End: 197-1471
agtgcggccgcgaagcagagcgggctgtagagccttgcgcgcgcagtggggatggaacgttgctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtgtttcatgggactcccttccggatgagctgctcttgggaatcttttcctgtctgtgcctccctgagctgctaaaggtctctggtgtttgtaagaggtggtatcgcctagcgtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagcccttttcgtgtacagcacatggacctatcgaactcagttatagaagtgtccaccctccacggcatactgtctcagtgttccaagttgcagaatctaagcctggaaggcctgcggctttcggatcccattgtcaatactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttacttgaacttggagaaattcccacactaaaaacactacaagtttttggaatcgtgccagatggtacccttcaactgttaaaggaagcccttcctcatctacagattaattgctcccatttcaccaccattgccaggccaactattggcaacaaaaagaaccaggagatatggggcatcaaatgccgactgacactgcaaaagcccagttgtctatgaagtatttattgcaggatggtgtctcttctttagaacagggaaaataggcaggaagcccaattgctggagtacttagctagttttattcttggttttccctttgccttcattctgcaagtatactagggagccatttgagagggaaaactatgaaatcttgctttttgaaatgattctaaaagcttctatcactgctttgctcttaagagccaaagttgtaggccttttgaaattttaggagagtgagcctataatttcaagataccttaaagagcaaaatttgagccacctcttccaagtgcccttcttactaagtctattcagaatcaagcttaaaaattaccaccagcaaacaatcttcatagcccatataacttttatctatttaattttatagtattgctttataagacagcttagaagaacaataagctatttgtattatgagctgaacaaaaagagaatcataggatagtagcgtctgaggccatcttttctaggaataggaaagagaaaaatgtatttgaattttgcctttagatttgaaattaggttaatagaaataagtaaccccatgtaattcaccttaaaacttaacaaaagaccaaacattacaaaacccagagatatagaatcaatataggatttgaaggcccagcagacagttttctatgacaggttaatctgaagtatcctgtaatgttcattaagttactgtgtttccagaatctaaattagatgagaaatataattgtggttttctaacttgataatcaaattatgttaacatgggtcctttagcttttaaaatgacttgctttgttttagaaaggtggtattaatccactctctattcttgaaaatttggatgggagaattctgaagttgcctgctgttttcctttagcgctgaggttcttaaggttacttttatattactctggaatcaagtattttaaattgtattttttttttaaatgatctctcagcaataattgtttgaaactatccatatataaggttatcagacctacagttccctaagaggaactgcatgttctcttcaatcagaaatatacagtagaagcaggtatatcttccatgcagtttcagtagtaagcactacttatacctacataagagttaaaatccagatgtgggaccttttgataccatcagtgatatatatttttttaaactggtacagagaagtgaaaagattaaattctacttctattttttttttttttttttgagacggagtctcgctctgtcaccaaggccggagtgcagtggtgcgatctcggctcactgcaagctccgcctcccaggttcacgtcattctcctgcctcagcctcccgactagctgggactacaggcgcccaccaccacgcccggctaatttttttgtatttttagtagagacggggtttcaccatgttagccaggatggtctcaatctcctgacctcatgatccgcccgtcttggcctcccaaagtgctgggattacaggcatgagcaactgcgcccagccaaattctacttcttaaaaatcacaaaaactagtttaaattgatgacttgttcgtatgttcaaaatgtaacaacaaaaaaagctaacaccagtcatttatattaactttttttttttaaatcaaaaattgttaatgttagaaacatactatgaagtgcctttatctgcttagacctaaggaagattttaaagttgggttgcacaggaaatgatgatgcttcaatttcttaatagttaaaaagtgctaaatactacttgaaattattgtttacagattagtgacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttataaaaatgagtgcttaaactaagttgtattccttttttctttctctttttttaagtgctgtggttaaaatttgaaagcatttagtgtggtatgccatttggcttagatacctctaaataagactcttcaaaacagagccctgagatggtcctttttgacccatctacttcatatgcttgtcacattaaaaaaaaaagtttataatgcctttataaaaggggctaatacagtcttgttatctttttttttaaattatactttaagttctagggtacatgtgcacaacgtgcaggttt

SEQ ID NO: 185839 - DNA, 821 bp, Homo sapiens
  Payload ID: 16591
  Gene Symbol: SKP2
  Gene Name: S-phase kinase-associated protein 2, E3 ubiquitin protein ligase
  ENST ID: ENST00000508514
  CDS Start-End: 142-795
aacgttgctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttacttgaacttggagaaattcccacactaaaaacactacaagtttttggaatcgtgccagatggtacccttcaactgttaaaggaagcccttcctcatctacagattaattgctcccatttcaccaccattgccaggccaactattggcaacaaaaagaaccaggagatatggggcatcaaatgccgactgacactgcaaaagcccagttgtctatgaagtatttattgcaggatggtgtctct

SEQ ID NO: 185840 - DNA, 901 bp, Homo sapiens
  Payload ID: 16591
  Gene Symbol: SKP2
  Gene Name: S-phase kinase-associated protein 2, E3 ubiquitin protein ligase
  ENST ID: ENST00000513151
  CDS Start-End: 136-901
gctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtgtttcatgggactcccttccggatgagctgctcttgggaatcttttcctgtctgtgcctccctgagctgctaaaggtctctggtgtttgtaagaggtggtatcgcctagcgtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagtactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcag

SEQ ID NO: 185841 - DNA, 574 bp, Homo sapiens
  Payload ID: 16591
  Gene Symbol: SKP2
  Gene Name: S-phase kinase-associated protein 2, E3 ubiquitin protein ligase
  ENST ID: ENST00000504386
  CDS Start-End: 1-243
tcaaacctgggccacccggagagccccccacggaaacggctgaagagcaaagggagtgacaaagactttgtgattgtccgcaggcctaagctaaatcgagagaactttccaggtgtttcatgggactcccttccggatgagctgctcttgggaatcttttcctgtctgtgcctccctgagctgctaaaggtctctggtgtttgtaagaggtggtatcgcctagcatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttactattagtgacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttataaaaa

SEQ ID NO: 185842 - DNA, 1646 bp, Homo sapiens
  Payload ID: 16591
  Gene Symbol: SKP2
  Gene Name: S-phase kinase-associated protein 2, E3 ubiquitin protein ligase
  ENST ID: ENST00000509692
  CDS Start-End: 136-444
gctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagtactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttacttgaacttggagaaattcccacactaaaaacactacaagtttttggaatcgtgccagatggtacccttcaactgttaaaggaagcccttcctcatctacagattaattgctcccatttcaccaccattgccaggccaactattggcaacaaaaagaaccaggagatatggggcatcaaatgccgactgacactgcaaaagcccagttgtctatgaagtatttattgcaggatggtgtctcttctttagaacagggaaaataggcaggaagcccaattgctggagtacttagctagttttattcttggttttccctttgccttcattctgcaagtatactagggagccatttgagagggaaaactatgaaatcttgctttttgaaatgattctaaaagcttctatcactgctttgctcttaagagccaaagttgtaggccttttgaaattttaggagagtgagcctataatttcaagataccttaaagagcaaaatttgagccacctcttccaagtgcccttcttactaagtctattcagaatcaagcttaaaaattaccaccagcaaacaatcttcatagcccatataacttttatctatttaattttatagtattgctttataagacagcttagaagaacaataagctatttgtattatgagctgaacaaaaagagaatcataggatagtagcgtct

SEQ ID NO: 185843 - DNA, 694 bp, Homo sapiens
  Payload ID: 16591
  Gene Symbol: SKP2
  Gene Name: S-phase kinase-associated protein 2, E3 ubiquitin protein ligase
  ENST ID: ENST00000513263
  CDS Start-End: 95-403
cgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagcccttttcgtgtacagcacatggacctatcgaactcagttatagaagtgtccaccctccacggcatactgtctcagtgttccaagttgcagaatctaagcctggaaggcctgcggctttcggatcccattgtcaatactctcgcaaaaaactcaaatttagtgcgacttaaccttt

SEQ ID NO: 185844 - DNA, 1589 bp, Homo sapiens
  Payload ID: 16591
  Gene Symbol: SKP2
  Gene Name: S-phase kinase-associated protein 2, E3 ubiquitin protein ligase
  ENST ID: ENST00000546211
  CDS Start-End: 141-1448
cgggctgtagagccttgcgcgcgcagtggggatggaacgttgctaggcttagcgggtctggctgctgggggcccgagcagcacgctcggagccgccgcgcgccaaagcgggaatctgggaggcgagcagctctgcagttaatgcacgtatttactcccgggcctgcggacgctatgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtgtttcatgggactcccttccggatgagctgctcttgggaatcttttcctgtctgtgcctccctgagctgctaaaggtctctggtgtttgtaagaggtggtatcgcctagcgtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagcccttttcgtgtacagcacatggacctatcgaactcagttatagaagtgtccaccctccacggcatactgtctcagtgttccaagttgcagaatctaagcctggaaggcctgcggctttcggatcccattgtcaatactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttacttgaacttggagaaattcccacactaaaaacactacaagtttttggaatcgtgccagatggtacccttcaactgttaaaggaagcccttcctcatctacagattaattgctcccatttcaccaccattgccaggccaactattggcaacaaaaagaaccaggagatatggggcatcaaatgccgactgacactgcaaaagcccagttgtctatgaagtatttattgcaggatggtgtctcttctttagaacagggaaaataggcaggaagcccaattgctggagtacttagctagttttattcttggttttccctttgccttcattctgcaagtatactagggagccatttgagag

SEQ ID NO: 185845 - DNA, 3255 bp, Homo sapiens
  Payload ID: 16591
  Gene Symbol: SKP2
  Gene Name: S-phase kinase-associated protein 2, E3 ubiquitin protein ligase
  Uniprot ID: Q13309
  ENST ID: ENST00000620197
  CDS Start-End: 616-1248
aattcccagcaggccttgggcctcagtgcggccgcgaagcagagcgggctgtagagccttgcgcgcgcagtggggatggaacgttgctaggcttagcgggtctggctgctgggggcccgagcagcacgctcggagccgccgcgcgccaaagcgggaatctgggaggcgagcagctctgcagttaatgcacgtattttaaactcccgggcctgcggacgctatgcacaggaagcacctccaggagattccagacctgagtagcaacgttgccaccagcttcacgtggggatgggattccagcaagacttctgaactgctgtcaggcatgggggtctccgccctggagaaagaggagcccgacagtgagaacatcccccaggaactgctctcaaacctgggccacccggagagccccccacggaaacggctgaagagcaaagggagtgacaaagactttgtgattgtccgcaggcctaagctaaatcgagagaactttccaggtctgatgagtctctatggcagaccttagacctcacaggtaaaaatctgcacccggatgtgactggtcggttgctgtctcaaggggtgattgccttccgctgcccacgatcatttatggaccaaccattggctgaacatttcagtactctcgcaaaaaactcaaatttagtgcgacttaacctttctgggtgttctggattctctgaatttgccctgcagactttgctaagcagctgttccagactggatgagctgaacctctcctggtgttttgatttcactgaaaagcatgtacaggtggctgttgcgcatgtgtcagagaccatcacccagctgaatcttagcggctacagaaagaatctccagaaatcagatctctctactttagttagaagatgccccaatcttgtccatctagacttaagtgatagtgtcatgctaaagaatgactgctttcaggaatttttccagctcaactacctccaacacctatcactcagtcggtgctatgatataatacctgaaactttacttgaacttggagaaattcccacactaaaaacactacaagtttttggaatcgtgccagatggtacccttcaactgttaaaggaagcccttcctcatctacagattaattgctcccatttcaccaccattgccaggccaactattggcaacaaaaagaaccaggagatatggggcatcaaatgccgactgacactgcaaaagcccagttgtctatgaagtatttattgcaggatggtgtctcttctttagaacagggaaaataggcaggaagcccaattgctggagtacttagctagttttattcttggttttccctttgccttcattctgcaagtatactagggagccatttgagagggaaaactatgaaatcttgctttttgaaatgattctaaaagcttctatcactgctttgctcttaagagccaaagttgtaggccttttgaaattttaggagagtgagcctataatttcaagataccttaaagagcaaaatttgagccacctcttccaagtgcccttcttactaagtctattcagaatcaagcttaaaaattaccaccagcaaacaatcttcatagcccatataacttttatctatttaattttatagtattgctttataagacagcttagaagaacaataagctatttgtattatgagctgaacaaaaagagaatcataggatagtagcgtctgaggccatcttttctaggaataggaaagagaaaaatgtatttgaattttgcctttagatttgaaattaggttaatagaaataagtaaccccatgtaattcaccttaaaacttaacaaaagaccaaacattacaaaacccagagatatagaatcaatataggatttgaaggcccagcagacagttttctatgacaggttaatctgaagtatcctgtaatgttcattaagttactgtgtttccagaatctaaattagatgagaaatataattgtggttttctaacttgataatcaaattatgttaacatgggtcctttagcttttaaaatgacttgctttgttttagaaaggtggtattaatccactctctattcttgaaaatttggatgggagaattctgaagttgcctgctgttttcctttagcgctgaggttcttaaggttacttttatattactctggaatcaagtattttaaattgtattttttttttaaatgatctctcagcaataattgtttgaaactatccatatataaggttatcagacctacagttccctaagaggaactgcatgttctcttcaatcagaaatatacagtagaagcaggtatatcttccatgcagtttcagtagtaagcactacttatacctacataagagttaaaatccagatgtgggaccttttgataccatcagtgatatatatttttttaaactggtacagagaagtgaaaagattaaattctacttctattttttttttttttttttgagacggagtctcgctctgtcaccaaggccggagtgcagtggtgcgatctcggctcactgcaagctccgcctcccaggttcacgtcattctcctgcctcagcctcccgactagctgggactacaggcgcccaccaccacgcccggctaatttttttgtatttttagtagagacggggtttcaccatgttagccaggatggtctcaatctcctgacctcatgatccgcccgtcttggcctcccaaagtgctgggattacaggcatgagcaactgcgcccagccaaattctacttcttaaaaatcacaaaaactagtttaaattgatgacttgttcgtatgttcaaaatgtaacaacaaaaaaagctaacaccagtcatttatattaactttttttttttaaatcaaaaattgttaatgttagaaacatactatgaagtgcctttatctgcttagacctaaggaagattttaaagttgggttgcacaggaaatgatgatgcttcaatttcttaatagttaaaaagtgctaaatactacttgaaattattgtttacagattagtgacaagagctggggttaggatccggttggactctgacatcggatgccctcaaacatacagaacttccaaactcaagtccagccataagctattttgccaacatgtcagagtaatctgtatttttgtatgtgatttctacttttatagacttgttttaaaacaataaaacacatttttataaaaatgagtgctt

SEQ ID NO: 185846 - DNA, 648 bp, Homo sapiens
  Payload ID: 16592
  Gene Symbol: SPHAR
  Gene Name: S-phase response (cyclin related)
  Uniprot ID: Q15513
  ENST ID: ENST00000366688
  CDS Start-End: 279-470
tatattgggtatattgaagtatatattgtattacaaagacttgttcttgtattttaaaatgtcagtgcaaaaaatatatggtggaacctttctttaaagttgaaatgcagtattatttaaatctgaaaggttaaaaagctttcttcaccttatatatgttcttccactgtgactttttagttgaagactagtaaattaacttttagttagaagatgcctactgcttttgttgtttattttaatcagcagagcacagagacacataaaaactctgggaaatgactaggataaaaatatcagtatgtatctgttttagatattttgagttttgctttttttatgccttgaatattttatttcaaaaagtatctgaagcaaattctcagactgaactacttcttagacctcactgtaagaatattttattcaatgtctcatttatgatagatttgcaagctgctcatttttgaacagctttttgcatgggataggagcatgtctattctaacacatcagcttattcaaaagcaagaattttaaaaataagataaatgtaaagttgttttataaacgatcctgttaattaaaccacagacaccatatatccttctgcatcctttggccaataaaagttgctggagaaccaaa

SEQ ID NO: 185847 - DNA, 2452 bp, Homo sapiens
  Payload ID: 16593
  Gene Symbol: SMPD1
  Gene Name: sphingomyelin phosphodiesterase 1, acid lysosomal
  Uniprot ID: P17405
  ENST ID: ENST00000342245
  CDS Start-End: 169-2064
ggaagaggaaggggcggagctgctttgcggccggccgcggagcagtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggtgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactcc

SEQ ID NO: 185848 - DNA, 447 bp, Homo sapiens
  Payload ID: 16593
  Gene Symbol: SMPD1
  Gene Name: sphingomyelin phosphodiesterase 1, acid lysosomal
  ENST ID: ENST00000530395
  CDS Start-End: 290-447
ggagctgctttgcggccggccgcggagcagtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgt

SEQ ID NO: 185849 - DNA, 1451 bp, Homo sapiens
  Payload ID: 16593
  Gene Symbol: SMPD1
  Gene Name: sphingomyelin phosphodiesterase 1, acid lysosomal
  ENST ID: ENST00000531303
  CDS Start-End: 18-533
gtgtaggaagcgcgacaatgccccgctacggagcgtcactccgccagagctgccccaggtccggccgggagcagggacaagacgggaccgccggagcccccggactcctttggatgggcctggtgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaagaaggaacccaatgtggctcgcgtgggctccgtggccatcaagctgtgcaatctgctgaagatagcaccacctgccgtgtgccaatccattgtccacctctttgaggatgacatggtggagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctgtcagccccacatccttgcaggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggat

SEQ ID NO: 185850 - DNA, 2446 bp, Homo sapiens
  Payload ID: 16593
  Gene Symbol: SMPD1
  Gene Name: sphingomyelin phosphodiesterase 1, acid lysosomal
  ENST ID: ENST00000534405
  CDS Start-End: 127-1335
cagtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggtgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcaggtacttatcgtccgtggaaacccaggaagggaaaagaaagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttgga

SEQ ID NO: 185851 - DNA, 2188 bp, Homo sapiens
  Payload ID: 16593
  Gene Symbol: SMPD1
  Gene Name: sphingomyelin phosphodiesterase 1, acid lysosomal
  Uniprot ID: P17405
  ENST ID: ENST00000527275
  CDS Start-End: 125-2017
gtcagccgactacagagaagggtaatcgggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggtgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcagaattggggggttctatgctctttccccataccccggtctccgcctcatctctctcaatatgaatttttgttcccgtgagaacttctggctcttgatcaactccacggatcccgcaggacagctccagtggctggtgggggagcttcaggctgctgaggatcgaggagacaaagtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggat

SEQ ID NO: 185852 - DNA, 2211 bp, Homo sapiens
  Payload ID: 16593
  Gene Symbol: SMPD1
  Gene Name: sphingomyelin phosphodiesterase 1, acid lysosomal
  ENST ID: ENST00000533123
  CDS Start-End: 97-1197
ggtgtccccggcgccgcccggggccctgagggctggctagggtccaggccgggggggacgggacagacgaaccagccccgtgtaggaagcgcgacaatgccccgctacggagcgtcactccgccagagctgccccaggtccggccgggagcagggacaagacgggaccgccggagcccccggactcctttggatgggcctggtgctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcaggtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactccaga

SEQ ID NO: 185853 - DNA, 1344 bp, Homo sapiens
  Payload ID: 16593
  Gene Symbol: SMPD1
  Gene Name: sphingomyelin phosphodiesterase 1, acid lysosomal
  ENST ID: ENST00000526280
  CDS Start-End: 1-953
cttttgatatggtgtactggacaggagacatccccgcacatgatgtctggcaccagactcgtcaggaccaactgcgggccctgaccaccgtcacagcacttgtgaggaagttcctggggccagtgccagtgtaccctgctgtgggtaaccatgaaagcacacctgtcaatagcttccctccccccttcattgagggcaaccactcctcccgctggctctatgaagcgatggccaaggcttgggagccctggctgcctgccgaagccctgcgcaccctcaggtacttatcgtccgtggaaacccaggaagggaaaagaaaggtgcatataattggccacattcccccagggcactgtctgaagagctggagctggaattattaccgaattgtagccaggtatgagaacaccctggctgctcagttctttggccacactcatgtggatgaatttgaggtcttctatgatgaagagactctgagccggccgctggctgtagccttcctggcacccagtgcaactacctacatcggccttaatcctggttaccgtgtgtaccaaatagatggaaactactccgggagctctcacgtggtcctggaccatgagacctacatcctgaatctgacccaggcaaacataccgggagccataccgcactggcagcttctctacagggctcgagaaacctatgggctgcccaacacactgcctaccgcctggcacaacctggtatatcgcatgcggggcgacatgcaacttttccagaccttctggtttctctaccataagggccacccaccctcggagccctgtggcacgccctgccgtctggctactctttgtgcccagctctctgcccgtgctgacagccctgctctgtgccgccacctgatgccagatgggagcctcccagaggcccagagcctgtggccaaggccactgttttgctagggccccagggcccacatttgggaaagttcttgatgtaggaaagggtgaaaaagcccaaatgctgctgtggttcaaccaggcaagatcatccggtgaaagaaccagtccctgggccccaaggatgccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactccaga

SEQ ID NO: 185854 - DNA, 1645 bp, Homo sapiens
  Payload ID: 16594
  Gene Symbol: SMPD2
  Gene Name: sphingomyelin phosphodiesterase 2, neutral membrane (neutral sphingomyelinase)
  Uniprot ID: O60906
  ENST ID: ENST00000258052
  CDS Start-End: 360-1631
gcggccgcgaccgccggggacgagcttggaggaaaaggaaccgggagccgcccacccgggggcgctctccggacccccagggtcctagcgcgcggcccttaccgagcctgggcgcccggatttcggcagcggatcgcctttccgggttggcggcccgcctgattgggaacagccggccggttgccgggggaacgcgggagtcgggcccgacctgagccacgcgggcttggtgcccacctgtgcgcgccgcctgcgaagaaggaacggtctggggagaaggcgccgccggccgcccccgtccccaccgcggccgtcgctggagagttcgagccgcctagcgcccctggagctccccaaccatgaagcccaacttctccctgcgactgcggatcttcaacctcaactgctggggcattccgtacttgagcaagcaccgggccgaccgcatgaggcgcctgggagactttctgaaccaggagagcttcgacctggctttgctggaggaggtgtggagtgagcaggacttccagtacctgagacagaagctgtcacctacctacccagctgcacaccacttccggagcggaatcattggcagtggcctctgtgtcttctccaaacatccaatccaggagcttacccagcacatctacactctcaatggctacccctacatgatccatcatggtgactggttcagtgggaaggctgtggggctgctggtgctccatctaagtggcatggtgctcaacgcctatgtgacccatctccatgccgaatacaatcgacagaaggacatctacctagcacatcgtgtggcccaagcttgggaattggcccagttcatccaccacacatccaagaaggcagacgtggttctgttgtgtggagacctcaacatgcacccagaagacctgggctgctgcctgctgaaggagtggacagggcttcatgatgcctatcttgaaactcgggacttcaagggctctgaggaaggcaacacaatggtacccaagaactgctacgtcagccagcaggagctgaagccatttccctttggtgtccgcattgactacgtgctttacaaggcagtttctgggttttacatctcctgtaagagttttgaaaccactacaggctttgaccctcacaggggcacccccctctctgatcatgaagccctgatggctactctgtttgtgaggcacagccccccacagcagaaccccagctctacccacggaccagcagagaggtcgccgttgatgtgtgtgctaaaggaggcctggacggagctgggtctgggcatggctcaggctcgctggtgggccaccttcgctagctatgtgattggcctggggctgcttctcctggcactgctgtgtgtcctggcggctggaggaggggccggggaagctgccatactgctctggacccccagtgtagggctggtgctgtgggcaggtgcattctacctcttccacgtacaggaggtcaatggcttatatagggcccaggctgagctccagcatgtgctaggaagggcaagggaggcccaggatctgggcccagagcctcagccagccctactcctggggcagcaggagggggacagaactaaagaacaataaagcttggcccttta

SEQ ID NO: 185855 - DNA, 613 bp, Homo sapiens
  Payload ID: 16594
  Gene Symbol: SMPD2
  Gene Name: sphingomyelin phosphodiesterase 2, neutral membrane (neutral sphingomyelinase)
  ENST ID: ENST00000458487
  CDS Start-End: 1-613
acatctacctagcacatcgtgtggcccaagcttgggaattggcccagttcatccagtgtgtgagcctgggcttgaaatgggaagtgggatgggacccaggggctgagggtgaacaaggccccagtcatggggaagagctggtgatggaagaactcccgcctcaccaacctggttcccccagccacacatccaagaaggcagacgtggttctgttgtgtggagacctcaacatgcacccagaagacctgggctgctgcctgctgaaggagtggacagggcttcatgatgcctatcttgaaactcgggacttcaagggctctgaggaaggcaacacaatggtacccaagaactgctacgtcagccagcaggagctgaagccatttccctttggtgtccgcattgactacgtgctttacaaggcagtttctgggttttacatctcctgtaagagttttgaaaccactacaggctttgaccctcacaggggcacccccctctctgatcatgaagccctgatggctactctgtttgtgaggcacagccccccacagcagaaccccagctctacccacggaccagcagagaggtcgccgttgatgtgtgtgctaaagga

SEQ ID NO: 185856 - DNA, 5453 bp, Homo sapiens
  Payload ID: 16595
  Gene Symbol: SMPD3
  Gene Name: sphingomyelin phosphodiesterase 3, neutral membrane (neutral sphingomyelinase II)
  Uniprot ID: Q9NY59
  ENST ID: ENST00000219334
  CDS Start-End: 605-2572
ggtctctgggggatgtggtcttgaaggagagacccaggaacctgcgggcggggccggagggagaggggaggacgcccccaatgggcagactcctgggcggggtccgggtcaccattggctccggcggcgcgagggaggcggggtcagaggaatgaagcgcggagctgttcgccgctccaggtgctgagtctgagggaggctccggacccgagagccgcgagagccgccgccgctgcggccgccgccagatctgcggccgggagcccgggctgtgaggagccgggaggagcggggtgcgctgccgggcgctgaccgccctcccgcccgccgtcagaggtctgcggtgacagctcttcttcagagagaaggacaacaaggtcccagtggcccctcctcagggtctgcagtaggcctccgcatggcccaccgaggtgaaccatgaccggctggccaacattcgccattgaccagccggagttgcatctcgccaggaggtgacccctcctccagctgcccccaactcgcccaccctcgcccaggaaagtgcccgcagctgccacggacaccatgtagtagggccggctgcggcgcccagtgagctgcgatggttttgtacacgaccccctttcctaacagctgtctgtccgccctgcactgtgtgtcctgggcccttatctttccatgctactggctggtggaccggctcgctgcctccttcatacccaccacctacgagaagcgccagcgggcagacgacccgtgctgcctgcagctgctctgcactgccctcttcacgcccatctacctggccctcctggtggcctcgctgccctttgcgtttctcggctttctcttctggtccccactgcagtcggcccgccggccctacatctattcacggctggaagacaagggcctggccggtggggcagccctgctcagtgaatggaagggcacggggcctggcaaaagcttctgctttgccactgccaacgtctgcctcctgcccgactcactcgccagggtcaacaacctttttaacacccaagcgcgggccaaggagatcgggcagagaatccgcaatggggccgcccggccccagatcaaaatttacatcgactcccccaccaatacctccatcagcgccgctagcttcagcagcctggtgtcaccacagggcggcgatggggtggcccgggccgtccccgggagcattaagaggacagcctctgtggagtacaagggtgacggtgggcggcaccccggtgacgaggctgccaacggcccagcctctggggaccctgtcgacagcagcagcccggaggatgcctgcatcgtgcgcatcggtggcgaggagggcggccggccacctgaagctgacgaccctgtgcctgggggccaggccaggaacggagctggcgggggcccaaggggccagacgcccaaccataatcagcaggacggggattcagggagcctgggcagcccctcggcctcccgggagtccctggtgaaggggcgagctgggccagacaccagtgccagcggggagccaggtgccaacagcaagctcctgtacaaggcctcggtggtgaagaaggcggctgcacgcaggaggcggcaccccgacgaggccttcgaccatgaggtctccgccttcttccccgccaacctggacttcctgtgcctgcaggaggtgtttgacaagcgagcagccaccaaattgaaagagcagctgcacggctacttcgagtacatcctgtacgacgtcggggtctacggctgccagggctgctgcagcttcaagtgtctcaacagcggcctcctctttgccagccgctaccccatcatggacgtggcctatcactgttaccccaacaagtgtaacgacgatgccctggcctctaagggagctctgtttctcaaggtgcaggtgggaagcacacctcaggaccaaagaatcgtcgggtacatcgcctgcacacacctgcatgccccgcaagaggacagcgccatccggtgtgggcagctggacctgcttcaggactggctggctgatttccgaaaatctacctcctcgtccagcgcagccaaccccgaggagctggtggcatttgacgtcgtctgtggagatttcaactttgataactgctcctctgacgacaagctggagcagcaacactccctgttcacccactacagggacccctgccgcctggggcctggtgaggagaagccgtgggccatcggtactctgctggacacgaacggcctgtacgatgaggatgtgtgcacccccgacaacctgcagaaggtcctggagagtgaggagggccgcagggagtacctggcgtttcccaccagcaagagctcgggccagaaggggcggaaggagctgctgaagggcaacggccggcgcatcgactacatgctgcatgcagaggaggggctgtgcccagactggaaggccgaggtggaagaattcagttttatcacccagctgtccggcctgacggaccacctgccagtagccatgcgactgatggtgtcttcgggggaggaggaggcatagaccgtccggagcagcggggcctctgccagcccttgcagctgcagcccatccctgggccatgtcccctccatcgagtgcccggtgcttgggggaggagggcagggacagggagggagccacagtcagtgcccgggaacctggaagctgcgctgctctgcgcctctgggcctcactgtggacagaggagtcaggcccgccccaggagcctccagctgcctaaccagtgccattctttcacaacacgattttctacaaatctacagcacaaccgagtttgtaacccgtgggttagtatgaggaccgggttcgtgtactctctgtatctcctcttaagcttcgtccagggttctttatttttgtctgctgccaatgtcgtctcgcatgcctgcaccctcgcatgcacgctgcccgcatgccacgtgccacgctgtagccacagaccccttgctcgggcctcacccaaggccaaactccaaacacaatcagaaccagccaaagaagcacttcctgggcacggccaccagctctcccgcctccagtgtgggccggctcctgcagggtccgagggctgcatctctaccagccagcccagggctcttcccagggtctcgcattcaagggcaattacattttaaaaagaaaaacagaaaaaggttaatcacaaaaccaaccctcacttcacagggtctgtaagtcactcatagaactttgctcttcccgagacagggtcccttccccagctcaggcacaacagagtctggcaggctctggcaccctgggcctcctccgggagcctcccatctgggcagtggagccataaacggggatccgagaagagagtatccacttttttttttacaggaagaagggactcacagcataaacgggggtgggggggatcctgattttgaaaataatctatttgtagcttctcttctatcaaaaccaacacatcctcttctttctgccaatcctctcccccacgggacacctctctggttcgggaccaatccctccctggggacgtgccccacctgcgtgccggctgagctcaggaacccctgcctgccccccgggtggggctgcggctctggcctcccaggcccatcctcaacagctaccccagccaacaccaaggccacaaggggaccccggcctaggaggcaggaagccaaggtgcagagagcagcctggccctcaccagtgcgcaagctggggcagcaaggctgacagttgctgcatgcccagggcagggtgtggtactggcacccaagttcagcatggcagagctggccaacagcttgtggtccccgatctgcctccagccccaagatgcctacagcccccaggccccttcggcagcactgcctctgcccacctgcctttaagagactccagggctgctcctgtcatgcagcgaaggttttgtctgtttcaaagttcgagactcaacttgagggactgtttttgacaatccccgctgacctccgctcctcgtggcgccctggccctacacccagcctggcccagggccggctttgcctggtgaggctggagggagcaccaggacctgctgtctgctgtcagcccctcctggtgctggtgccctgatgctgtgccttgtcacccattgagctgcaagagggaccaagagggggccacgcagccagccagatgcctggccctgtgctggggcagacaacgctgcagagcccagggagcctggcgctaggacgtgcgtccttgtgacactggcctgtctgaactcacctggcctgggaagcaccgtctgcccgggcccaagccctgcccctccagagtccagagccaggaaggggctgctgagggcgagcatcctgctgggctctctgcccggcccacccctccaaggggctggcctgtgagccttgactgggattcatgatgtggaggcccccaacttccagaagcagctggtactctgctcacacaagcgactgggccggccggccctggacccctagaccccgagccgcctgccgactgcctgcacagggagagcagttgaggcccgggcagggcccccacaccagaccccaacatagcttccccacccaggcaccccctcccggggcagcaggcgtgggagtcagggctgcatgctcctcccctcccacctcacaggcggccttaggcaagtcattttctgtcatcacaaggtcgcctctgcctagtcaggtcctggggtccagagtaaggatgtgcggcccccaggcccccgcacacctccctcagcaccaagaccgggacccccccacccacgtgtctcattgtggctgcctatggactcccgggccttgtgtgcaggccaggcccttccactgattttttaaagtgaaccattgctggatctcagattctgtggcatctaaggcctagcaggggtgggcacacgggtcacccgaggcccataccaagactctgttcctgccctaggcccagtctcaaaggaagccacaaggcgcgggggccactgaggaaggaaatgttcattttcatttgtccaaaaccaccttaagttttaagtatattaatcttgatgctttttaactattgctttttaacttgctgagatttagaaatactgttataaaaacttttttaatttctgtatttttttctgtattgtatcttcatgggacattaggggttttctatggtaagcacacctatggttttggtaaaaacattatcaaatatatatccagacggttcttccctagaagaaaaacaagtctttacacctgataaaatattttgcgaagagaggtgttctttttccttactggtgctgaaaggaaggatggataacgaggagaaaataaaactgtgaggctcaagg

SEQ ID NO: 185857 - DNA, 2093 bp, Homo sapiens
  Payload ID: 16595
  Gene Symbol: SMPD3
  Gene Name: sphingomyelin phosphodiesterase 3, neutral membrane (neutral sphingomyelinase II)
  Uniprot ID: Q9NY59
  ENST ID: ENST00000563226
  CDS Start-End: 78-2021
accctcgcccaggaaagtgcccgcagctgccacggacaccatgtagtagggccggctgcggcgcccagtgagctgcgatggttttgtacacgaccccctttcctaacagctgtctgtccgccctgcactgtgtgtcctgggcccttatctttccatgctactggctggtggaccggctcgctgcctccttcatacccaccacctacgagaagcgccagcgggcagacgacccgtgctgcctgcagctgctctgcactgccctcttcacgcccatctacctggccctcctggtggcctcgctgccctttgcgtttctcggctttctcttctggtccccactgcagtcggcccgccggccctacatctattcacggctggaagacaagggcctggccggtggggcagccctgctcagtgaatggaagggcacggggcctggcaaaagcttctgctttgccactgccaacgtctgcctcctgcccgactcactcgccagggtcaacaacctttttaacacccaagcgcgggccaaggagatcgggcagagaatccgcaatggggccgcccggccccagatcaaaatttacatcgactcccccaccaatacctccatcagcgccgctagcttcagcagcctggtgtcaccacagggcggcgatggggtggcccgggccgtccccgggagcattaagaggacagcctctgtggagtacaagggtgacggtgggcggcaccccggtgacgaggctgccaacggcccagcctctggggaccctgtcgacagcagcagcccggaggatgcctgcatcgtgcgcatcggtggcgaggagggcggccggccacctgaagctgacgaccctgtgcctgggggccaggccaggaacggagctggcgggggcccaaggggccagacgcccaaccataatcagcaggacggggattcagggagcctgggcagcccctcggcctcccgggagtccctggtgaaggggcgagctgggccagacaccagtgccagcggggagccaggtgccaacagcaagctcctgtacaaggcctcggtggtgaagaaggcggctgcacgcaggaggcggcaccccgacgaggccttcgaccatgaggtctccgccttcttccccgccaacctggacttcctgtgcctgcaggaggtgtttgacaagcgagcagccaccaaattgaaagagcagctgcacggctacttcgagtacatcctgtacgacgtcggggtctacggctgccagggctgctgcagcttcaagtgtctcaacagcggcctcctctttgccagccgctaccccatcatggacgtggcctatcactgttaccccaacaagtgtaacgacgatgccctggcctctaagggagctctgtttctcaaggtgcaggtgggaagcacacctcaggaccaaagaatcgtcgggtacatcgcctgcacacacctgcatgccccgcaagaggacagcgccatccggtgtgggcagctggacctgcttcaggactggctggctgatttccgaaaatctacctcctcgtccagcgcagccaaccccgaggagctggtggcatttgacgtcgtctgtggagatttcaactttgataactgctcctctgacgacaagctggagcagcaacactccctgttcacccactacagggacccctgccgcctggggcctggtactctgctggacacgaacggcctgtacgatgaggatgtgtgcacccccgacaacctgcagaaggtcctggagagtgaggagggccgcagggagtacctggcgtttcccaccagcaagagctcgggccagaaggggcggaaggagctgctgaagggcaacggccggcgcatcgactacatgctgcatgcagaggaggggctgtgcccagactggaaggccgaggtggaagaattcagttttatcacccagctgtccggcctgacggaccacctgccagtagccatgcgactgatggtgtcttcgggggaggaggaggcatagaccgtccggagcagcggggcctctgccagcccttgcagctgcagcccatccctgggccatgtcccctccatc

SEQ ID NO: 185858 - DNA, 627 bp, Homo sapiens
  Payload ID: 16595
  Gene Symbol: SMPD3
  Gene Name: sphingomyelin phosphodiesterase 3, neutral membrane (neutral sphingomyelinase II)
  ENST ID: ENST00000561749
  CDS Start-End: 347-627
aggctccggacccgagagccgcgagagccgccgccgctgcggccgccgccagatctgcggccgggagcccgggctgtgaggagccgggaggagcggggtgcgctgccgggcgctgaccgccctcccgcccgccgtcagagggtctgcagtaggcctccgcatggcccaccgaggtgaaccatgaccggctggccaacattcgccattgaccagccggagttgcatctcgccaggaggtgacccctcctccagctgcccccaactcgcccaccctcgcccaggaaagtgcccgcagctgccacggacaccatgtagtagggccggctgcggcgcccagtgagctgcgatggttttgtacacgaccccctttcctaacagctgtctgtccgccctgcactgtgtgtcctgggcccttatctttccatgctactggctggtggaccggctcgctgcctccttcatacccaccacctacgagaagcgccagcgggcagacgacccgtgctgcctgcagctgctctgcactgccctcttcacgcccatctacctggccctcctggtggcctcgctgccctttgcgtttctcggctttctcttctggtccccactgcagtcggcccgccggcc

SEQ ID NO: 185859 - DNA, 2073 bp, Homo sapiens
  Payload ID: 16595
  Gene Symbol: SMPD3
  Gene Name: sphingomyelin phosphodiesterase 3, neutral membrane (neutral sphingomyelinase II)
  ENST ID: ENST00000568373
  CDS Start-End: 78-1994
accctcgcccaggaaagtgcccgcagctgccacggacaccatgtagtagggccggctgcggcgcccagtgagctgcgatggttttgtacacgaccccctttcctaacagctgtctgtccgccctgcactgtgtgtcctgggcccttatctttccatgctactggctggtggaccggctcgctgcctccttcatacccaccacctacgagaagcgccagcgggcagacgacccgtgctgcctgcagctgctctgcactgccctcttcacgcccatctacctggccctcctggtggcctcgctgccctttgcgtttctcggctttctcttctggtccccactgcagtcggcccgccggccctacatctattcacggctggaagacaagggcctggccggtggggcagccctgctcagtgaatggaagggcacggggcctggcaaaagcttctgctttgccactgccaacgtctgcctcctgcccgactcactcgccagggtcaacaacctttttaacacccaagcgcgggccaaggagatcgggcagagaatccgcaatggggccgcccggccccagatcaaaatttacatcgactcccccaccaatacctccatcagcgccgctagcttcagcagcctggtgtcaccacagggcggcgatggggtggcccgggccgtccccgggagcattaagaggacagcctctgtggagtacaagggtgacggtgggcggcaccccggtgacgaggctgccaacggcccagcctctggggaccctgtcgacagcagcagcccggaggatgcctgcatcgtgcgcatcggtggcgaggagggcggccggccacctgaagctgacgaccctgtgcctgggggccaggccaggaacggagctggcgggggcccaaggggccagacgcccaaccataatcagcaggacggggattcagggagcctgggcagcccctcggcctcccgggagtccctggtgaaggggcgagctgggccagacaccagtgccagcggggagccaggtgccaacagcaagctcctgtacaaggcctcggtggtgaagaaggcggctgcacgcaggaggcggcaccccgacgaggccttcgaccatgaggtctccgccttcttccccgccaacctggacttcctgtgcctgcaggaggtgtttgacaagcgagcagccaccaaattgaaagagcagctgcacggctacttcgagtacatcctgtacgacgtcggggtctacggctgccagggctgctgcagcttcaagtgtctcaacagcggcctcctctttgccagccgctaccccatcatggacgtggcctatcactgttaccccaacaagtgtaacgacgatgccctggcctctaagggagctctgtttctcaaggtgcaggtgggaagcacacctcaggaccaaagaatcgtcgggtacatcgcctgcacacacctgcatgccccgcaagaggacagcgccatccggtgtgggcagctggacctgcttcaggactggctggctgatttccgaaaatctacctcctcgtccagcgcagccaaccccgaggagctggtggcatttgacgtcgtctgtggagatttcaactttgataactgctcctctgacgacaagctggagcagcaacactccctgttcacccactacagggacccctgccgcctggggcctggtgaggagaagccgtgggccatcggtactctgctggacacgaacggcctgtacgatgaggatgtgtgcacccccgacaacctgcagaacaagagctcgggccagaaggggcggaaggagctgctgaagggcaacggccggcgcatcgactacatgctgcatgcagaggaggggctgtgcccagactggaaggccgaggtggaagaattcagttttatcacccagctgtccggcctgacggaccacctgccagtagccatgcgactgatggtgtcttcgggggaggaggaggcatagaccgtccggagcagcggggcctctgccagcccttgcagctgcagcccatccctgggccatgtcccctccatcgagtgcc

SEQ ID NO: 185860 - DNA, 1755 bp, Homo sapiens
  Payload ID: 16595
  Gene Symbol: SMPD3
  Gene Name: sphingomyelin phosphodiesterase 3, neutral membrane (neutral sphingomyelinase II)
  ENST ID: ENST00000574662
  CDS Start-End: 1-622
ggctgccagggctgctgcagcttcaagtgtctcaacagcggcctcctctttgccagccgctaccccatcatggacgtggcctatcactgttaccccaacaagtgtaacgacgatgccctggcctctaagggagctctgtttctcaaggtgcaggtgggaagcacacctcaggaccaaagaatcgtcgggtacatcgcctgcacacacctgcatgccccgcaagaggacagcgccatccggtgtgggcagctggacctgcttcaggactggctggctgatttccgaaaatctacctcctcgtccagcgcagccaaccccgaggagctggtggcatttgacgtcgtctgtggagatttcaactttgataactgctcctctgacgacaagctggagcagcaacactccctgttcacccactacagggacccctgccgcctggggcctggtgaggagaagccgtgggccatcggtactctgctggacacgaacggcctgtacgatgaggatgtgtgcacccccgacaacctgcagaaggtcctggagagtgaggagggccgcagggagtacctggcgtttcccaccagcaagagctcgggccagaaggggcggaaggagctgctgaagggcaacggccggcgcatcgactacatgctgcatgcagaggaggggctgtgcccagactggaaggccgtgagtcaggagggcccagcagccagggccatgcaaagagagagcagggcccgggccctgcagctctcgacagccgctccctgaaaccccacgccccaggccactcttacaatgatacccatcactccctcagacccttagggccccaggtcctccaggccccatccctctgactgcaggaaggtcccagcccaccccagccccggggcctcactttggggatccccaggccgctccctgcaagatgcccttggaatctgaccaggctgtttctcccctctcccactcaccccaggaggtggaagaattcagttttatcacccagctgtccggcctgacggaccacctgccagtagccatgcgactgatggtgtcttcgggggaggaggaggcatagaccgtccggagcagcggggcctctgccagcccttgcagctgcagcccatccctgggccatgtcccctccatcgagtgcccggtgcttgggggaggagggcagggacagggagggagccacagtcagtgcccgggaacctggaagctgcgctgctctgcgcctctgggcctcactgtggacagaggagtcaggcccgccccaggagcctccagctgcctaaccagtgccattctttcacaacacgattttctacaaatctacagcacaaccgagtttgtaacccgtgggttagtatgaggaccgggttcgtgtactctctgtatctcctcttaagcttcgtccagggttctttatttttgtctgctgccaatgtcgtctcgcatgcctgcaccctcgcatgcacgctgcccgcatgccacgtgccacgctgtagccacagaccccttgctcgggcctcacccaaggccaaactccaaacacaatcagaaccagccaaagaagcacttcctgggcacggccaccagctctcccgcctccagtgtgggccggctcctgcagggtccgagggctgcatctctaccagccagcccagggctcttcccagggtctcgcattcaagggcaattacattttaaaaagaaaaacagaaaaaggttaatcacaaaacc

SEQ ID NO: 185861 - DNA, 3661 bp, Homo sapiens
  Payload ID: 16596
  Gene Symbol: SMPD4
  Gene Name: sphingomyelin phosphodiesterase 4, neutral membrane (neutral sphingomyelinase-3)
  ENST ID: ENST00000351288
  CDS Start-End: 1-2514
atgacgactttcggcgccgtggcggaatggcggcttccatctctgaggcgagcgacgctatggatcccacagtggtttgctaagaaggccattttcaactctccactggaggctgctatggcgttccctcacctgcagcagcccagctttctactggctagcctgaaagctgactctataaataagccctttgcacagcagtgccaagacttggttaaagtcattgaggactttccagcaaaggagctgcacaccatcttcccatggctggtagaaagcatttttggcagcctagatggtgtcctcgttggctggaacctccgctgcttacaggggcgcgtgaatcctgtggagtacagcatcgtgatggaatttctcgaccctggtggcccaatgatgaagttggtttataagcttcaagctgaagactataagttcgactttcctgtctcctacttgcctggtcctgtgaaggcgtccatccaggagtgcatcctccctgacagtcctctgtaccacaacaaggtccagttcacccctactgggggccttggtctgaacttggccctgaatccgttcgagtattacatattcttctttgccttgagcctcatcactcagaagccacttcctgtgtccctccacgtccgtacttcagactgtgcctatttcatcctggtggacaggtacctgtcatggttcctgcccaccgaaggcagtgtgcccccaccactctcctccagcccaggggggaccagcccctcaccacctcccaggacaccagccataccctttgcttcctatggcctccaccacactagcctcctaaagcgacacatctctcatcagacgtctgtgaatgcagaccccgcctcccacgagatctggaggtcagaaactctgctccaggtttttgttgaaatgtggcttcatcactattccttggagatgtatcaaaaaatgcagtcccctcatgccaaggagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacgggctgctgtcccgaggttcgtccagcagaaactctacctcttcttgcagcattgctttggccactggcccctggacgcatcgttcagagctgtcctggagatgtggctgagctacctgcagccgtggcggtacgcgcctgacaagcaggctccgggcagcgactcccagccccggtgtgtgtcggagaaatgggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccgatgtttgggcccgaggcccgcaccctggtcctgcgcctcgctcagctcatcacacaggccaaacacacagccaagtccatctccgaccagtgtgcggagagcccggctggccactccttcctctcatggctgggctttagctccatggacaccaatggctcctacacagccaacgacctggacgagatggggcaagacagtgtccggaagacagatgaatacctggagaaggccctggagtacctgcgccagatattccggctcagcgaagcgcagctcaggcagttcacactcgccttgggcaccacccaggatgagaatggaaaaaagcaactccccgactgcatcgtgggtgaggacggactcatccttacgcccctggggcggtaccagatcatcaatgggctgcgaaggtttgaaattgagtaccagggggacccggagctgcagcccatccggagctatgagatcgccagcttggtccgcacactctttaggctgtcgtctgccatcaaccacagatttgcaggacagatggcggctctgtgttcccgggatgacttcctcggcagcttctgtcgctaccacctcacagaacctgggctggccagcaggcacctgctgagccctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcacgctgctgctcaccctgggctatgtcctctacgcctctgccatgacactgctgaccgagcgggggaagctgcaccagccctgaaggtgtcagctgccttcagagcaggctggagggatttgccacacagccccacccttgggctgagaggacctgggaagcccctccaggagggaacacggtcatcctcgggcttctggagcggggttcctgcagccgcagaggcatctggaggaaacgcaaccaagaaaggaaggcaggtgggccccagcaaaggagtagctgccagggctcaacagctacgctctgtgacagcgcagagctcagcggcggcctttccctccctccgccaaggactcacggccaagccagctctcggggccttttttccactgcccatttggctactctgctgcaccaagcttgggagccagcctgccaacagccacctgggcctggcctccccactggctggccttgaggttggcagagtgggttgtggcgcttcctctctctgtgtgggaccaggacagtggcttaagtctccactccaggaaagaatcaaagtttctagagttgtgagaaaaccagagagtggctgtcctgattcttcactgtgaggggcgttcttcatgttctcccagctgttccaagactgggccgtagaattccatgtttcaggagcctaagaccctcccagagcccaggggcttcaccgcagaccccaagccattgagcacatcacccaaagcagtggccaacatcgcggacccctgtgccttgtcacagatgggtgctggtcctcaggcgttggggacactgctgggtcgatggggtcggattctgccagtttctgctctgcagccaaagatggtcagaagcattgtcacttcagtaacatcaagtgctcaaagacatggcaaccgttcagtggtacttaagtattcaaaatatacaactacagattctctgacagaaaccagcacggggtcttcaccttcattcaccccacaggcgacatgcgagggagaacagcatctcagtggtgatttccaaaccaagcctttgttttcggtgtggggttttgggggtttgctttaatgtttttgaaattgtaaatgttgggctttgtattttgatgtaaactgagcataatggcattttagggcctgtgaccaaaaatgaagcttgtaacgaccatggatctgaataaacatgtccttgcttctga

SEQ ID NO: 185862 - DNA, 4896 bp, Homo sapiens
  Payload ID: 16596
  Gene Symbol: SMPD4
  Gene Name: sphingomyelin phosphodiesterase 4, neutral membrane (neutral sphingomyelinase-3)
  ENST ID: ENST00000409031
  CDS Start-End: 1150-3750
gggcagagacacggccgcagggtcctggggctcgctcgctagcctctgcccggcacacatggacttgagcatctggaagacggcgaggggggccacgttcagcttcagcaggtccaccaggatcctggcggggacagacgcggggccggtgagccctctccgcccggcgcggccacctccctgaagacccgacaaggacgggggcgggggctcctcccgaccagcgggccgggcgtacccggaaagcagaggtcggggggtgtctggctagcatgcggcccccacccgccccgctcacttgaacacgtcggggtcgatagcgccgcccgccgcctgcgccagctcgtacagctccatctcctcggtgctcagcaccttcttccgccgcagcgccagcttctgccgggccgcctccagccccgggggcgccgccgaccccggcccaggccctacgccctgcgccgccatccccgcggcccgcggaaaggtgcgctccgccccgccgcgccccctagcggctgcgcccaccaccctctccctgcagcgtcaacgtctggcctcccgggctgccctggcgggaggggcgggagcgcggggacggggccgcctccgcggcgtcattgaagcccaacagttattgggcgctcacggtgtgctgagcggcgctctaggagccgggagtggcatggcggaccgcaggggtccgctgcttggcgatctgggcctccctgatagactgcattggtcgtgctcgcttaggtggcagcacccagcccagtgccaggcatacattgggcgctcggtaaatgcctctttcaagaaagcgtgcaattttctggtccgcaccggtgcaccactaggggtcgcttttcggggcgggcggggggaaggggggggcactaatcaacaatactgcttacgcgcacgcggattccttgctggggagaaagtaccttggggcgccggaggccgccacaacgcaggcgcattcagctaaggaccactccctcccccgcactcctgcctcgccatttctcttccccgcccggccggccttcgctttgcgcacgcgccttttgaggtaacggcccaaagaggtggaagcgcttttcccgcccggccgcggggcgtggctctgcgcgcagcttgatgacgactttcggcgccgtggcggaatggcggcttccatctctgaggcgagcgacgctatggatcccacagtggtttgctaagaaggccattttcaactctccactggaggctgctatggcgttccctcacctgcagcagcccagctttctactggctagcctgaaagctgactctataaataagccctttgcacagcagtgccaagacttggttaaagtcattgaggactttccagcaaaggagctgcacaccatcttcccatggctggtagaaagcatttttggcagcctagatggtgtcctcgttggctggaacctccgctgcttacaggggcgcgtgaatcctgtggagtacagcatcgtgatggaatttctcgaccctggtggcccaatgatgaagttggtttataagcttcaagctgaagactataagttcgactttcctgtctcctacttgcctggtcctgtgaaggcgtccatccaggagtgcatcctccctgacagtcctctgtaccacaacaaggtccagttcacccctactgggggccttggtctgaacttggccctgaatccgttcgagtattacatattcttctttgccttgagcctcatcactcagaagccacttcctgtgtccctccacgtccgtacttcagactgtgcctatttcatcctggtggacaggtacctgtcatggttcctgcccaccgaaggcagtgtgcccccaccactctcctccagcccaggggggaccagcccctcaccacctcccaggacaccagccataccctttgcttcctatggcctccaccacactagcctcctaaagcgacacatctctcatcagacgtctgtgaatgcagaccccgcctcccacgagatctggaggtcagaaactctgctccaggtttttgttgaaatgtggcttcatcactattccttggagatgtatcaaaaaatgcagtcccctcatgccaagctggaggttctgcactaccgactcagtgtctccagcgccctctacagccccgcccaacccagcctccaggccctccacgcctaccaagagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacgggctgctgtcccgaggttcgtccagcagaaactctacctcttcttgcagcattgctttggccactggcccctggacgcatcgttcagagctgtcctggagatgtggctgagctacctgcagccgtggcggtacgcgcctgacaagcaggctccgggcagcgactcccagccccggtgtgtgtcggagaaatgggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccgatgtttgggcccgaggcccgcaccctggtcctgcgcctcgctcagctcatcacacaggccaaacacacagccaagtccatctccgaccagtgtgcggagagcccggctggccactccttcctctcatggctgggctttagctccatggacaccaatggctcctacacagccaacgacctggacgagatggggcaagacagtgtccggaagacagatgaatacctggagaaggccctggagtacctgcgccagatattccggctcagcgaagcgcagctcaggcagttcacactcgccttgggcaccacccaggatgagaatggaaaaaagcaactccccgactgcatcgtgggtgaggacggactcatccttacgcccctggggcggtaccagatcatcaatgggctgcgaaggtttgaaattgagtaccagggggacccggagctgcagcccatccggagctatgagatcgccagcttggtccgcacactctttaggctgtcgtctgccatcaaccacagatttgcaggacagatggcggctctgtgttcccgggatgacttcctcggcagcttctgtcgctaccacctcacagaacctgggctggccagcaggcacctgctgagccctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcacgctgctgctcaccctgggctatgtcctctacgcctctgccatgacactgctgaccgagcgggggaagctgcaccagccctgaaggtgtcagctgccttcagagcaggctggagggatttgccacacagccccacccttgggctgagaggacctgggaagcccctccaggagggaacacggtcatcctcgggcttctggagcggggttcctgcagccgcagaggcatctggaggaaacgcaaccaagaaaggaaggcaggtgggccccagcaaaggagtagctgccagggctcaacagctacgctctgtgacagcgcagagctcagcggcggcctttccctccctccgccaaggactcacggccaagccagctctcggggccttttttccactgcccatttggctactctgctgcaccaagcttgggagccagcctgccaacagccacctgggcctggcctccccactggctggccttgaggttggcagagtgggttgtggcgcttcctctctctgtgtgggaccaggacagtggcttaagtctccactccaggaaagaatcaaagtttctagagttgtgagaaaaccagagagtggctgtcctgattcttcactgtgaggggcgttcttcatgttctcccagctgttccaagactgggccgtagaattccatgtttcaggagcctaagaccctcccagagcccaggggcttcaccgcagaccccaagccattgagcacatcacccaaagcagtggccaacatcgcggacccctgtgccttgtcacagatgggtgctggtcctcaggcgttggggacactgctgggtcgatggggtcggattctgccagtttctgctctgcagccaaagatggtcagaagcattgtcacttcagtaacatcaagtgctcaaagacatggcaaccgttcagtggtacttaagtattcaaaatatacaactacagattctctgacagaaaccagcacggggtcttcaccttcattcaccccacaggcgacatgcgagggagaacagcatctcagtggtgatttccaaaccaagcctttgttttcggtgtggggttttgggggtttgctttaatgtttttgaaattgtaaatgttgggctttgtattttgatgtaaactgagcataatggcattttagggcctgtgaccaaaaatgaagcttgtaacgaccatggatctgaataaacatgtccttgcttctg

SEQ ID NO: 185863 - DNA, 842 bp, Homo sapiens
  Payload ID: 16596
  Gene Symbol: SMPD4
  Gene Name: sphingomyelin phosphodiesterase 4, neutral membrane (neutral sphingomyelinase-3)
  ENST ID: ENST00000435455
  CDS Start-End: 330-596
tcttctttgccttgagcctcatcactcagaagccacttcctgtgtccctccacgtccgtacttcagactgtgcctatttcatcctggtggacaggtacctgtcatggttcctgcccaccgaaggcagtgtgcccccaccactctcctccagcccaggggggaccagcccctcaccacctcccaggacaccagccataccctttgcttcctatggcctccaccacactagcctcctaaagcgacacatctctcatcagacgtctgtgaatgcagaccccgcctcccacgagatctggaggtcagaaactctgctccaggtttttgttgaaatgtggcttcatcactattccttggagatgtatcaaaaaatgcagtcccctcatgccaaggagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacgcattgctttggccactggcccctggacgcatcgttcagagctgtcctggagatgtggctgagctacctgcagccgtggcggtacgcgcctgacaagcaggctccgggcagcgactcccagccccggtgtgtgtcggagaaatgggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaag

SEQ ID NO: 185864 - DNA, 940 bp, Homo sapiens
  Payload ID: 16596
  Gene Symbol: SMPD4
  Gene Name: sphingomyelin phosphodiesterase 4, neutral membrane (neutral sphingomyelinase-3)
  ENST ID: ENST00000457039
  CDS Start-End: 1-940
aaacgggctgctgtcccgaggttcgtccagcagaaactctacctcttcttgcagcattgctttggccactggcccctggacgcatcgttcagagctgtcctggagatgtggctgagctacctgcagccgtggcggtacgcgcctgacaagcaggctccgggcagcgactcccagccccggtgtgtgtcggagaaatgggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccgatgtttgggcccgaggcccgcaccctggtcctgcgcctcgctcagctcatcacacaggccaaacacacagccaagtccatctccgaccagtgtgcggagagcccggctggccactccttcctctcatggctgggctttagctccatggacaccaatggctcctacacagccaacgacctggacgagatggggcaagacagtgtccggaagacagatgaatacctggagaaggccctggagtacctgcgccagatattccggtttgcaggacagatggcggctctgtgttcccgggatgacttcctcggcagcttctgtcgctaccacctcacagaacctgggctggccagcaggcacctgctgagccctgtggggcggaggcaggtggccggccacaccc

SEQ ID NO: 185865 - DNA, 3335 bp, Homo sapiens
  Payload ID: 16596
  Gene Symbol: SMPD4
  Gene Name: sphingomyelin phosphodiesterase 4, neutral membrane (neutral sphingomyelinase-3)
  ENST ID: ENST00000433118
  CDS Start-End: 116-286
gacgactttcggcgccgtggcggaatggcggcttccatctctgaggcgagcgacgctatggatcccacagtggtttgctaagaaggccattttcaactctccactggaggctgctatggcgttccctcacctgcagcagcccagctttctactggctagcctgaaagctgactctataaataagccctttgcacagcagtgccaagacttggttaaagtcattgaggactttccagcaaaggacaccagccataccctttgcttcctatggcctccaccacactagcctcctaaagcgacacatctctcatcagacgtctgtgaatgcagaccccgcctcccacgagatctggaggtcagaaactctgctccaggtttttgttgaaatgtggcttcatcactattccttggagatgtatcaaaaaatgcagtcccctcatgccaagctggaggttctgcactaccgactcagtgtctccagcgccctctacagccccgcccaacccagcctccaggccctccacgcctaccaaatggagtctcactccgttgcccaggctggaatgcattgacatggtctcggctcactgcaatctccacctcccagattgaagtgattcttctgcctcagcctcttgagtagctgggattacaggagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacgggctgctgtcccgaggttcgtccagcagaaactctacctcttcttgcagcattgctttggccactggcccctggacgcatcgttcagagctgtcctggagatgtggctgagctacctgcagccgtggcggtacgcgcctgacaagcaggctccgggcagcgactcccagccccggtgtgtgtcggagaaatgggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccgatgtttgggcccgaggcccgcaccctggtcctgcgcctcgctcagctcatcacacaggccaaacacacagccaagtccatctccgaccagtgtgcggagagcccggctggccactccttcctctcatggctgggctttagctccatggacaccaatggctcctacacagccaacgacctggacgagatggggcaagacagtgtccggaagacagatgaatacctggagaaggccctggagtacctgcgccagatattccggctcagcgaagcgcagctcaggcagttcacactcgccttgggcaccacccaggatgagaatggaaaaaagcaactccccgactgcatcgtgggtgaggacggactcatccttacgcccctggggcggtaccagatcatcaatgggctgcgaaggtttgaaattgagtaccagggggacccggagctgcagcccatccggagctatgagatcgccagcttggtccgcacactctttaggctgtcgtctgccatcaaccacagatttgcaggacagatggcggctctgtgttcccgggatgacttcctcggcagcttctgtcgctaccacctcacagaacctgggctggccagcaggcacctgctgagccctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcacgctgctgctcaccctgggctatgtcctctacgcctctgccatgacactgctgaccgagcgggggaagctgcaccagccctgaaggtgtcagctgccttcagagcaggctggagggatttgccacacagccccacccttgggctgagaggacctgggaagcccctccaggagggaacacggtcatcctcgggcttctggagcggggttcctgcagccgcagaggcatctggaggaaacgcaaccaagaaaggaaggcaggtgggccccagcaaaggagtagctgccagggctcaacagctacgctctgtgacagcgcagagctcagcggcggcctttccctccctccgccaaggactcacggccaagccagctctcggggccttttttccactgcccatttggctactctgctgcaccaagcttgggagccagcctgccaacagccacctgggcctggcctccccactggctggccttgaggttggcagagtgggttgtggcgcttcctctctctgtgtgggaccaggacagtggcttaagtctccactccaggaaagaatcaaagtttctagagttgtgagaaaaccagagagtggctgtcctgattcttcactgtgaggggcgttcttcatgttctcccagctgttccaagactgggccgtagaattccatgtttcaggagcctaagaccctcccagagcccaggggcttcaccgcagaccccaagccattgagcacatcacccaaagcagtggccaacatcgcggacccctgtgccttgtcacagatgggtgctggtcctcaggcgttggggacactgctgggtcgatggggtcggattctgccagtttctgctctgcagccaaagatggtcagaagcattgtcacttcagtaacatcaagtgctcaaagacatggcaaccgttcagtggtacttaagtattcaaaatatacaactacagattctctgacagaaaccagcacggggtcttcaccttcattcaccccacaggcgacatgcgagggagaacagcatctcagtggtgatttccaaaccaagcctttgttttcggtgtggggttttgggggtttgctttaatgtttttgaaattgtaaatgttgggctttgtattttgatgtaaactgagcataatggcattttagggcctgtgaccaaaaatgaagcttgtaacgaccatggatctgaataaacatgtccttgcttctga

SEQ ID NO: 185866 - DNA, 3371 bp, Homo sapiens
  Payload ID: 16596
  Gene Symbol: SMPD4
  Gene Name: sphingomyelin phosphodiesterase 4, neutral membrane (neutral sphingomyelinase-3)
  ENST ID: ENST00000439886
  CDS Start-End: 1-2225
accacaacaaggtccagttcacccctactgggggccttggtctgaacttggccctgaatccgttcgagtattacatattcttctttgccttgagcctcatcactcagaagccacttcctgtgtccctccacgtccgtacttcagactgtgcctatttcatcctggtggacaggtacctgtcatggttcctgcccaccgaaggcagtgtgcccccaccactctcctccagcccaggggggaccagcccctcaccacctcccaggacaccagccataccctttgcttcctatggcctccaccacactagcctcctaaagcgacacatctctcatcagacgtctgtgaatgcagaccccgcctcccacgagatctggaggtcagaaactctgctccaggtttttgttgaaatgtggcttcatcactattccttggagatgtatcaaaaaatgcagtcccctcatgccaagctggaggttctgcactaccgactcagtgtctccagcgccctctacagccccgcccaacccagcctccaggccctccacgcctaccaagagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacgaatggggctgaacctcccggaggtgcccagtgctctcccccggcggagccaaccctcactgatgggagccctggggtcatctgtgagcagggcctccttactgggcaagcagcaggtgaccctccccatcccctgcagggctgctgtcccgaggttcgtccagcagaaactctacctcttcttgcagcattgctttggccactggcccctggacgcatcgttcagagctgtcctggagatgtggctgagctacctgcagccgtggcggtacgcgcctgacaagcaggctccgggcagcgactcccagccccggtgtgtgtcggagaaatgggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccgatgtttgggcccgaggcccgcaccctggtcctgcgcctcgctcagctcatcacacaggccaaacacacagccaagtccatctccgaccagtgtgcggagagcccggctggccactccttcctctcatggctgggctttagctccatggacaccaatggctcctacacagccaacgacctggacgagatggggcaagacagtgtccggaagacagatgaatacctggagaaggccctggagtacctgcgccagatattccggctcagcgaagcgcagctcaggcagttcacactcgccttgggcaccacccaggatgagaatggaaaaaagcaactccccgactgcatcgtgggtgaggacggactcatccttacgcccctggggcggtaccagatcatcaatgggctgcgaaggtttgaaattgagtaccagggggacccggagctgcagcccatccggagctatgagatcgccagcttggtccgcacactctttaggctgtcgtctgccatcaaccacagatttgcaggacagatggcggctctgtgttcccgggatgacttcctcggcagcttctgtcgctaccacctcacagaacctgggctggccagcaggcacctgctgagccctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcacgctgctgctcaccctgggctatgtcctctacgcctctgccatgacactgctgaccgagcgggggaagctgcaccagccctgaaggtgtcagctgccttcagagcaggctggagggatttgccacacagccccacccttgggctgagaggacctgggaagcccctccaggagggaacacggtcatcctcgggcttctggagcggggttcctgcagccgcagaggcatctggaggaaacgcaaccaagaaaggaaggcaggtgggccccagcaaaggagtagctgccagggctcaacagctacgctctgtgacagcgcagagctcagcggcggcctttccctccctccgccaaggactcacggccaagccagctctcggggccttttttccactgcccatttggctactctgctgcaccaagcttgggagccagcctgccaacagccacctgggcctggcctccccactggctggccttgaggttggcagagtgggttgtggcgcttcctctctctgtgtgggaccaggacagtggcttaagtctccactccaggaaagaatcaaagtttctagagttgtgagaaaaccagagagtggctgtcctgattcttcactgtgaggggcgttcttcatgttctcccagctgttccaagactgggccgtagaattccatgtttcaggagcctaagaccctcccagagcccaggggcttcaccgcagaccccaagccattgagcacatcacccaaagcagtggccaacatcgcggacccctgtgccttgtcacagatgggtgctggtcctcaggcgttggggacactgctgggtcgatggggtcggattctgccagtttctgctctgcagccaaagatggtcagaagcattgtcacttcagtaacatcaagtgctcaaagacatggcaaccgttcagtggtacttaagtattcaaaatatacaactacagattctctgacagaaaccagcacggggtcttcaccttcattcaccccacaggcgacatgcgagggagaacagcatctcagtggtgatttccaaaccaagcctttgttttcggtgtggggttttgggggtttgctttaatgtttttgaaattgtaaatgttgggctttgtattttgatgtaaactgagcataatggcattttagggcctgtgaccaaaaatgaagcttgtaacgaccatggatctgaataaacatgtccttgcttctg

SEQ ID NO: 185867 - DNA, 3601 bp, Homo sapiens
  Payload ID: 16596
  Gene Symbol: SMPD4
  Gene Name: sphingomyelin phosphodiesterase 4, neutral membrane (neutral sphingomyelinase-3)
  ENST ID: ENST00000412570
  CDS Start-End: 110-283
tttcggcgccgtggcggaatggcggcttccatctctgaggcgagcgacgctatggatcccacagtggtttgctaagaaggccattttcaactctccactggaggctgctatggcgttccctcacctgcagcagcccagctttctactggctagcctgaaagctgactctataaataagccctttgcacagcagtgccaagacttggttaaagtcattgaggactttccagcaaagatggtgtcctcgttggctggaacctccgctgcttacaggggcgcgtgaatcctgtggagtacagcatcgtgatggaatttctcgaccctggtggcccaatgatgaagttggtttataagcttcaagctgaagactataagttcgactttcctgtctcctacttgcctggtcctgtgaaggcgtccatccaggagtgcatcctccctgacagtcctctgtaccacaacaaggtccagttcacccctactgggggccttggtctgaacttggccctgaatccgttcgagtattacatattcttctttgccttgagcctcatcactcagaagccacttcctgtgtccctccacgtccgtacttcagactgtgcctatttcatcctggtggacaggtacctgtcatggttcctgcccaccgaaggcagtgtgcccccaccactctcctccagcccaggggggaccagcccctcaccacctcccaggacaccagccataccctttgcttcctatggcctccaccacactagcctcctaaagcgacacatctctcatcagacgtctgtgaatgcagaccccgcctcccacgagatctggaggtcagaaactctgctccaggtttttgttgaaatgtggcttcatcactattccttggagatgtatcaaaaaatgcagtcccctcatgccaaggagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacgggctgctgtcccgaggttcgtccagcagaaactctacctcttcttgcagcattgctttggccactggcccctggacgcatcgttcagagctgtcctggagatgtggctgagctacctgcagccgtggcggtacgcgcctgacaagcaggctccgggcagcgactcccagccccggtgtgtgtcggagaaatgggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccgatgtttgggcccgaggcccgcaccctggtcctgcgcctcgctcagctcatcacacaggccaaacacacagccaagtccatctccgaccagtgtgcggagagcccggctggccactccttcctctcatggctgggctttagctccatggacaccaatggctcctacacagccaacgacctggacgagatggggcaagacagtgtccggaagacagatgaatacctggagaaggccctggagtacctgcgccagatattccggctcagcgaagcgcagctcaggcagttcacactcgccttgggcaccacccaggatgagaatggaaaaaagcaactccccgactgcatcgtgggtgaggacggactcatccttacgcccctggggcggtaccagatcatcaatgggctgcgaaggtttgaaattgagtaccagggggacccggagctgcagcccatccggagctatgagatcgccagcttggtccgcacactctttaggctgtcgtctgccatcaaccacagatttgcaggacagatggcggctctgtgttcccgggatgacttcctcggcagcttctgtcgctaccacctcacagaacctgggctggccagcaggcacctgctgagccctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcacgctgctgctcaccctgggctatgtcctctacgcctctgccatgacactgctgaccgagcgggggaagctgcaccagccctgaaggtgtcagctgccttcagagcaggctggagggatttgccacacagccccacccttgggctgagaggacctgggaagcccctccaggagggaacacggtcatcctcgggcttctggagcggggttcctgcagccgcagaggcatctggaggaaacgcaaccaagaaaggaaggcaggtgggccccagcaaaggagtagctgccagggctcaacagctacgctctgtgacagcgcagagctcagcggcggcctttccctccctccgccaaggactcacggccaagccagctctcggggccttttttccactgcccatttggctactctgctgcaccaagcttgggagccagcctgccaacagccacctgggcctggcctccccactggctggccttgaggttggcagagtgggttgtggcgcttcctctctctgtgtgggaccaggacagtggcttaagtctccactccaggaaagaatcaaagtttctagagttgtgagaaaaccagagagtggctgtcctgattcttcactgtgaggggcgttcttcatgttctcccagctgttccaagactgggccgtagaattccatgtttcaggagcctaagaccctcccagagcccaggggcttcaccgcagaccccaagccattgagcacatcacccaaagcagtggccaacatcgcggacccctgtgccttgtcacagatgggtgctggtcctcaggcgttggggacactgctgggtcgatggggtcggattctgccagtttctgctctgcagccaaagatggtcagaagcattgtcacttcagtaacatcaagtgctcaaagacatggcaaccgttcagtggtacttaagtattcaaaatatacaactacagattctctgacagaaaccagcacggggtcttcaccttcattcaccccacaggcgacatgcgagggagaacagcatctcagtggtgatttccaaaccaagcctttgttttcggtgtggggttttgggggtttgctttaatgtttttgaaattgtaaatgttgggctttgtattttgatgtaaactgagcataatggcattttagggcctgtgaccaaaaatgaagcttgtaacgaccatggatctgaataaacatgtccttgcttctga

SEQ ID NO: 185868 - DNA, 635 bp, Homo sapiens
  Payload ID: 16596
  Gene Symbol: SMPD4
  Gene Name: sphingomyelin phosphodiesterase 4, neutral membrane (neutral sphingomyelinase-3)
  ENST ID: ENST00000449159
  CDS Start-End: 1-635
gtgtcggagaaatgggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaaggtgagcagctattcctggagccagagctggtcatcccccaccgccagcaccgactcttcacggcccccacattcactgggagcttcctgtcaccctggccaccagcggtcactgatgcctccttcaaggtcctgcgcctcgctcagctcatcacacaggccaaacacacagccaagtccatctccgaccagtgtgcggagagcccggctggccactccttcctctcatggctgggctttagctccatggacaccaatggctcctacacagccaacgacctggacgagatggggcaagacagtgtccggaagacagatgaatacctggagaaggccctggagtacctgcgccagatattccggctcagcgaagcgcagctcaggcagttcacactcgccttgggcaccacccaggatgagaatggaaaaaagcaactccccgactgcatcgtgggtga

SEQ ID NO: 185869 - DNA, 3614 bp, Homo sapiens
  Payload ID: 16596
  Gene Symbol: SMPD4
  Gene Name: sphingomyelin phosphodiesterase 4, neutral membrane (neutral sphingomyelinase-3)
  Uniprot ID: Q9NXE4
  ENST ID: ENST00000431183
  CDS Start-End: 157-2451
ctaaggaccactccctcccccgcactcctgcctcgccatttctcttccccgcccggccggccttcgctttgcgcacgcgccttttgaggtaacggcccaaagaggtggaagcgcttttcccgcccggccgcggggcgtggctctgcgcgcagcttgatgacgactttcggcgccgtggcggaatggcggcttccatctctgaggcgagcgacgctatggatcccacagtggtttgctaagaaggccattttcaactctccactggaggctgctatggcgttccctcacctgcagcagcccagctttctactggctagcctgaaagctgactctataaataagccctttgcacagcagtgccaagacttggttaaagtcattgaggactttccagcaaagggtcctgtgaaggcgtccatccaggagtgcatcctccctgacagtcctctgtaccacaacaaggtccagttcacccctactgggggccttggtctgaacttggccctgaatccgttcgagtattacatattcttctttgccttgagcctcatcactcagaagccacttcctgtgtccctccacgtccgtacttcagactgtgcctatttcatcctggtggacaggtacctgtcatggttcctgcccaccgaaggcagtgtgcccccaccactctcctccagcccaggggggaccagcccctcaccacctcccaggacaccagccataccctttgcttcctatggcctccaccacactagcctcctaaagcgacacatctctcatcagacgtctgtgaatgcagaccccgcctcccacgagatctggaggtcagaaactctgctccaggtttttgttgaaatgtggcttcatcactattccttggagatgtatcaaaaaatgcagtcccctcatgccaaggagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacgggctgctgtcccgaggttcgtccagcagaaactctacctcttcttgcagcattgctttggccactggcccctggacgcatcgttcagagctgtcctggagatgtggctgagctacctgcagccgtggcggtacgcgcctgacaagcaggctccgggcagcgactcccagccccggtgtgtgtcggagaaatgggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccgatgtttgggcccgaggcccgcaccctggtcctgcgcctcgctcagctcatcacacaggccaaacacacagccaagtccatctccgaccagtgtgcggagagcccggctggccactccttcctctcatggctgggctttagctccatggacaccaatggctcctacacagccaacgacctggacgagatggggcaagacagtgtccggaagacagatgaatacctggagaaggccctggagtacctgcgccagatattccggctcagcgaagcgcagctcaggcagttcacactcgccttgggcaccacccaggatgagaatggaaaaaagcaactccccgactgcatcgtgggtgaggacggactcatccttacgcccctggggcggtaccagatcatcaatgggctgcgaaggtttgaaattgagtaccagggggacccggagctgcagcccatccggagctatgagatcgccagcttggtccgcacactctttaggctgtcgtctgccatcaaccacagatttgcaggacagatggcggctctgtgttcccgggatgacttcctcggcagcttctgtcgctaccacctcacagaacctgggctggccagcaggcacctgctgagccctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcacgctgctgctcaccctgggctatgtcctctacgcctctgccatgacactgctgaccgagcgggggaagctgcaccagccctgaaggtgtcagctgccttcagagcaggctggagggatttgccacacagccccacccttgggctgagaggacctgggaagcccctccaggagggaacacggtcatcctcgggcttctggagcggggttcctgcagccgcagaggcatctggaggaaacgcaaccaagaaaggaaggcaggtgggccccagcaaaggagtagctgccagggctcaacagctacgctctgtgacagcgcagagctcagcggcggcctttccctccctccgccaaggactcacggccaagccagctctcggggccttttttccactgcccatttggctactctgctgcaccaagcttgggagccagcctgccaacagccacctgggcctggcctccccactggctggccttgaggttggcagagtgggttgtggcgcttcctctctctgtgtgggaccaggacagtggcttaagtctccactccaggaaagaatcaaagtttctagagttgtgagaaaaccagagagtggctgtcctgattcttcactgtgaggggcgttcttcatgttctcccagctgttccaagactgggccgtagaattccatgtttcaggagcctaagaccctcccagagcccaggggcttcaccgcagaccccaagccattgagcacatcacccaaagcagtggccaacatcgcggacccctgtgccttgtcacagatgggtgctggtcctcaggcgttggggacactgctgggtcgatggggtcggattctgccagtttctgctctgcagccaaagatggtcagaagcattgtcacttcagtaacatcaagtgctcaaagacatggcaaccgttcagtggtacttaagtattcaaaatatacaactacagattctctgacagaaaccagcacggggtcttcaccttcattcaccccacaggcgacatgcgagggagaacagcatctcagtggtgatttccaaaccaagcctttgttttcggtgtggggttttgggggtttgctttaatgtttttgaaattgtaaatgttgggctttgtattttgatgtaaactgagcataatggcattttagggcctgtgaccaaaaatgaagcttgtaacgaccatggatctgaataaacatgtccttgcttctgagtcttctggcacctgg

SEQ ID NO: 185870 - DNA, 796 bp, Homo sapiens
  Payload ID: 16596
  Gene Symbol: SMPD4
  Gene Name: sphingomyelin phosphodiesterase 4, neutral membrane (neutral sphingomyelinase-3)
  ENST ID: ENST00000451542
  CDS Start-End: 1-796
ttcatcctggtggacaggtacctgtcatggttcctgcccaccgaaggcagtgtgcccccaccactctcctccagcccaggggggaccagcccctcaccacctcccaggacaccagccataccctttgcttcctatggcctccaccacactagcctcctaaagcgacacatctctcatcagacgtctgtgaatgcagaccccgcctcccacgagatctggaggtcagaaactctgctccaggtttttgttgaaatgtggcttcatcactattccttggagatgtatcaaaaaatgcagtcccctcatgccaaggagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacgggctgctgtcccgaggttcgtccagcagaaactctacctcttcttgcagcattgctttggccactggcccctggacgcatcgttcagagctgtcctggagatgtggctgagctacctgcagccgtggcggtacgcgcctgacaagcaggctccgggcagcgactcccagccccgggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaag

SEQ ID NO: 185871 - DNA, 820 bp, Homo sapiens
  Payload ID: 16596
  Gene Symbol: SMPD4
  Gene Name: sphingomyelin phosphodiesterase 4, neutral membrane (neutral sphingomyelinase-3)
  ENST ID: ENST00000430682
  CDS Start-End: 1-820
tgtgtccctccacgtccgtacttcagactgtgcctatttcatcctggtggacaggtacctgtcatggttcctgcccaccgaaggcagtgtgcccccaccactctcctccagcccaggggggaccagcccctcaccacctcccaggacaccagccataccctttgcttcctatggcctccaccacactagcctcctaaagcgacacatctctcatcagacgtctgtgaatgcagaccccgcctcccacgagatctggaggtcagaaactctgctccaggtttttgttgaaatgtggcttcatcactattccttggagatgtatcaaaaaatgcagtcccctcatgccaaggtcctggagatgtggctgagctacctgcagccgtggcggtacgcgcctgacaagcaggctccgggcagcgactcccagccccggtgtgtgtcggagaaatgggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccgatgtttgggcccgaggcccgcaccctg

SEQ ID NO: 185872 - DNA, 699 bp, Homo sapiens
  Payload ID: 16596
  Gene Symbol: SMPD4
  Gene Name: sphingomyelin phosphodiesterase 4, neutral membrane (neutral sphingomyelinase-3)
  ENST ID: ENST00000441135
  CDS Start-End: 293-699
atggatcccacaggtgagtggcgcgggatgcgcgcctgagacggtccggcgccctgggggcttccccgagcccctgcggaggccatctccgttcctccgcgagccccaggactcgggccggccagccggctctgcccaggcagggcaggctggggagtggagggccccggttgagtcttctgccacccctctgggccatgcctttgtgccaccttcccgcgcggctcgtacactctgtcccggtccgtggtttgctaagaaggccattttcaactctccactggaggctgctatggcgttccctcacctgcagcagcccagctttctactggctagcctgaaagctgactctataaataagccctttgcacagcagtgccaagacttggttaaagtcattgaggactttccagcaaaggagctgcacaccatcttcccatggctggtagaaagcatttttggcagcctagatggtgtcctcgttggctggaacctccgctgcttacaggggcgcgtgaatcctgtggagtacagcatcgtgatggaatttctcgaccctggtggcccaatgatgaagttggtttataagcttcaagctgaagactataagttcgactttcctgtctcctacttgcctggtcctgtgaaggcgtccatccaggagtgcatcctccctgacagtcctctgtaccacaacaa

SEQ ID NO: 185873 - DNA, 3586 bp, Homo sapiens
  Payload ID: 16596
  Gene Symbol: SMPD4
  Gene Name: sphingomyelin phosphodiesterase 4, neutral membrane (neutral sphingomyelinase-3)
  ENST ID: ENST00000454468
  CDS Start-End: 96-248
cggaatggcggcttccatctctgaggcgagcgacgctatggatcccacagtggtttgctaagaaggccattttcaactctccactggaggctgctatggcgttccctcacctgcagcagcccagctttctactggctagcctgaaagctgactctataaataagccctttgcacagcagtgccaagacttggttaaagtcattgaggactttccagcaaagtggcccaatgatgaagttggtttataagcttcaagctgaagactataagttcgactttcctgtctcctacttgcctggtcctgtgaaggcgtccatccaggagtgcatcctccctgacagtcctctgtaccacaacaaggtccagttcacccctactgggggccttggtctgaacttggccctgaatccgttcgagtattacatattcttctttgccttgagcctcatcactcagaagccacttcctgtgtccctccacgtccgtacttcagactgtgcctatttcatcctggtggacaggtacctgtcatggttcctgcccaccgaaggcagtgtgcccccaccactctcctccagcccaggggggaccagcccctcaccacctcccaggacaccagccataccctttgcttcctatggcctccaccacactagcctcctaaagcgacacatctctcatcagacgtctgtgaatgcagaccccgcctcccacgagatctggaggtcagaaactctgctccaggtttttgttgaaatgtggcttcatcactattccttggagatgtatcaaaaaatgcagtcccctcatgccaagctggaggttctgcactaccgactcagtgtctccagcgccctctacagccccgcccaacccagcctccaggccctccacgcctaccaagagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacgggctgctgtcccgaggttcgtccagcagaaactctacctcttcttgcagcattgctttggccactggcccctggacgcatcgttcagagctgtcctggagatgtggctgagctacctgcagccgtggcggtacgcgcctgacaagcaggctccgggcagcgactcccagccccggtgtgtgtcggagaaatgggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccgatgtttgggcccgaggcccgcaccctggtcctgcgcctcgctcagctcatcacacaggccaaacacacagccaagtccatctccgaccagtgtgcggagagcccggctggccactccttcctctcatggctgggctttagctccatggacaccaatggctcctacacagccaacgacctggacgagatggggcaagacagtgtccggaagacagatgaatacctggagaaggccctggagtacctgcgccagatattccggctcagcgaagcgcagctcaggcagttcacactcgccttgggcaccacccaggatgagaatggaaaaaagcaactccccgactgcatcgtgggtgaggacggactcatccttacgcccctggggcggtaccagatcatcaatgggctgcgaaggtttgaaattgagtaccagggggacccggagctgcagcccatccggagctatgagatcgccagcttggtccgcacactctttaggctgtcgtctgccatcaaccacagatttgcaggacagatggcggctctgtgttcccgggatgacttcctcggcagcttctgtcgctaccacctcacagaacctgggctggccagcaggcacctgctgagccctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcacgctgctgctcaccctgggctatgtcctctacgcctctgccatgacactgctgaccgagcgggggaagctgcaccagccctgaaggtgtcagctgccttcagagcaggctggagggatttgccacacagccccacccttgggctgagaggacctgggaagcccctccaggagggaacacggtcatcctcgggcttctggagcggggttcctgcagccgcagaggcatctggaggaaacgcaaccaagaaaggaaggcaggtgggccccagcaaaggagtagctgccagggctcaacagctacgctctgtgacagcgcagagctcagcggcggcctttccctccctccgccaaggactcacggccaagccagctctcggggccttttttccactgcccatttggctactctgctgcaccaagcttgggagccagcctgccaacagccacctgggcctggcctccccactggctggccttgaggttggcagagtgggttgtggcgcttcctctctctgtgtgggaccaggacagtggcttaagtctccactccaggaaagaatcaaagtttctagagttgtgagaaaaccagagagtggctgtcctgattcttcactgtgaggggcgttcttcatgttctcccagctgttccaagactgggccgtagaattccatgtttcaggagcctaagaccctcccagagcccaggggcttcaccgcagaccccaagccattgagcacatcacccaaagcagtggccaacatcgcggacccctgtgccttgtcacagatgggtgctggtcctcaggcgttggggacactgctgggtcgatggggtcggattctgccagtttctgctctgcagccaaagatggtcagaagcattgtcacttcagtaacatcaagtgctcaaagacatggcaaccgttcagtggtacttaagtattcaaaatatacaactacagattctctgacagaaaccagcacggggtcttcaccttcattcaccccacaggcgacatgcgagggagaacagcatctcagtggtgatttccaaaccaagcctttgttttcggtgtggggttttgggggtttgctttaatgtttttgaaattgtaaatgttgggctttgtattttgatgtaaactgagcataatggcattttagggcctgtgaccaaaaatgaagcttgtaacgaccatggatctgaataaacatgtccttgcttctgagtc

SEQ ID NO: 185874 - DNA, 566 bp, Homo sapiens
  Payload ID: 16596
  Gene Symbol: SMPD4
  Gene Name: sphingomyelin phosphodiesterase 4, neutral membrane (neutral sphingomyelinase-3)
  ENST ID: ENST00000439029
  CDS Start-End: 113-283
gactttcggcgccgtggcggaatggcggcttccatctctgaggcgagcgacgctatggatcccacagtggtttgctaagaaggccattttcaactctccactggaggctgctatggcgttccctcacctgcagcagcccagctttctactggctagcctgaaagctgactctataaataagccctttgcacagcagtgccaagacttggttaaagtcattgaggactttccagcaaaggacaccagccataccctttgcttcctatggcctccaccacactagcctcctaaagcgacacatctctcatcagacgtctgtgaatgcagaccccgcctcccacgagatctggaggtcagaaactctgctccaggtttttgttgaaatgtggcttcatcactattccttggagatgtatcaaaaaatgcagtcccctcatgccaagctggaggttctgcactaccgactcagtgtctccagcgccctctacagccccgcccaacccagcctccaggccctccacgcctaccaagagtcgttcacgcctactgaggagcatgtgttggtg

SEQ ID NO: 185875 - DNA, 1851 bp, Homo sapiens
  Payload ID: 16597
  Gene Symbol: SMPDL3A
  Gene Name: sphingomyelin phosphodiesterase, acid-like 3A
  Uniprot ID: Q92484
  ENST ID: ENST00000368440
  CDS Start-End: 178-1539
cgctaaacagcagctgaaggtcaggcgaactgactcgctgcggaatctgcctttgcacgtgatcagtcggacgtctacacccgcagccgtcttctgtctccgcctcaccctcaggcctgacggtccgagtggagctgcgggacagcccgaacctccaggtcagccccgcggccctccatggcgctggtgcgcgcactcgtctgctgcctgctgactgcctggcactgccgctccggcctcgggctgcccgtggcgcccgcaggcggcaggaatcctcctccggcgataggacagttttggcatgtgactgacttacacttagaccctacttaccacatcacagatgaccacacaaaagtgtgtgcttcatctaaaggtgcaaatgcctccaaccctggcccttttggagatgttctgtgtgattctccatatcaacttattttgtcagcatttgattttattaaaaattctggacaagaagcatctttcatgatatggacaggggatagcccacctcatgttcctgtacctgaactctcaacagacactgttataaatgtgatcactaatatgacaaccaccatccagagtctctttccaaatctccaggttttccctgcgctgggtaatcatgactattggccacaggatcaactgcctgtagtcaccagtaaagtgtacaatgcagtagcaaacctctggaaaccatggctagatgaagaagctattagtactttaaggaaaggtggtttttattcacagaaagttacaactaatccaaaccttaggatcatcagtctaaacacaaacttgtactacggcccaaatataatgacactgaacaagactgacccagccaaccagtttgaatggctagaaagtacattgaacaactctcagcagaataaggagaaggtgtatatcatagcacatgttccagtggggtatctgccatcttcacagaacatcacagcaatgagagaatactataatgagaaattgatagatatttttcaaaaatacagtgatgtcattgcaggacaattttatggacacactcacagagacagcattatggttctttcagataaaaaaggaagtccagtaaattctttgtttgtggctcctgctgttacaccagtgaagagtgttttagaaaaacagaccaacaatcctggtatcagactgtttcagtatgatcctcgtgattataaattattggatatgttgcagtattacttgaatctgacagaggcgaatctaaagggagagtccatctggaagctggagtatatcctgacccagacctacgacattgaagatttgcagccggaaagtttatatggattagctaaacaatttacaatcctagacagtaagcagtttataaaatactacaattacttctttgtgagttatgacagcagtgtaacatgtgataagacatgtaaggcctttcagatttgtgcaattatgaatcttgataatatttcctatgcagattgcctcaaacagctttatataaagcacaattactagtatttcacagtttttgctaatagaaaatgctgattctgattctgagatcaatttgtgggaattttacataaatctttgttaattactgagtgggcaagtagacttcctgtctttgctttctttttttttttctttttgatgccttaatgtagatatctttatcattctgaattgtattatatatttaaagtgctcattaatagaatgatggatgtaaattggatgtaaatattcagtttatataattatatctaatttgtacccttgttgaaattgtcatttatacaataaagcgaattctttatctctaaa

SEQ ID NO: 185876 - DNA, 1755 bp, Homo sapiens
  Payload ID: 16597
  Gene Symbol: SMPDL3A
  Gene Name: sphingomyelin phosphodiesterase, acid-like 3A
  Uniprot ID: Q92484
  ENST ID: ENST00000539041
  CDS Start-End: 478-1446
accagtatgtcagtgtttgacatcaactgcaccactgatacacgagtcggaatttgagcttctacaagtacattccttcctaggccaaacactgacgctaagaaatacgagaacagatcatcgctaaacagcagctgaaggtcaggcgaactgactcgctgcggaatctgcctttgcacgtgatcagtcggacgtctacacccgcagccgtcttctgtctccgcctcaccctcaggcctgacggtccgagtggagctgcgggacagcccgaacctccaggtcagccccgcggccctccatggcgctggtgcgcgcactcgtctgctgcctgctgactgcctggcactgccgctccggcctcgggctgcccgtggcgcccgcaggcggcaggaatcctcctccggcgatagggatagcccacctcatgttcctgtacctgaactctcaacagacactgttataaatgtgatcactaatatgacaaccaccatccagagtctctttccaaatctccaggttttccctgcgctgggtaatcatgactattggccacaggatcaactgcctgtagtcaccagtaaagtgtacaatgcagtagcaaacctctggaaaccatggctagatgaagaagctattagtactttaaggaaaggtggtttttattcacagaaagttacaactaatccaaaccttaggatcatcagtctaaacacaaacttgtactacggcccaaatataatgacactgaacaagactgacccagccaaccagtttgaatggctagaaagtacattgaacaactctcagcagaataaggagaaggtgtatatcatagcacatgttccagtggggtatctgccatcttcacagaacatcacagcaatgagagaatactataatgagaaattgatagatatttttcaaaaatacagtgatgtcattgcaggacaattttatggacacactcacagagacagcattatggttctttcagataaaaaaggaagtccagtaaattctttgtttgtggctcctgctgttacaccagtgaagagtgttttagaaaaacagaccaacaatcctggtatcagactgtttcagtatgatcctcgtgattataaattattggatatgttgcagtattacttgaatctgacagaggcgaatctaaagggagagtccatctggaagctggagtatatcctgacccagacctacgacattgaagatttgcagccggaaagtttatatggattagctaaacaatttacaatcctagacagtaagcagtttataaaatactacaattacttctttgtgagttatgacagcagtgtaacatgtgataagacatgtaaggcctttcagatttgtgcaattatgaatcttgataatatttcctatgcagattgcctcaaacagctttatataaagcacaattactagtatttcacagtttttgctaatagaaaatgctgattctgattctgagatcaatttgtgggaattttacataaatctttgttaattactgagtgggcaagtagacttcctgtctttgctttctttttttttttctttttgatgccttaatgtagatatctttatcattctgaattgtattatatatttaaagtgctcattaatagaatgatggatgtaaattggatgtaaatattcagtttatataattatatctaatttgtacccttgttgaaattgtcatttatacaataaagcgaattctttatctct

SEQ ID NO: 185877 - DNA, 1548 bp, Homo sapiens
  Payload ID: 16598
  Gene Symbol: SMPDL3B
  Gene Name: sphingomyelin phosphodiesterase, acid-like 3B
  Uniprot ID: Q92485
  ENST ID: ENST00000373888
  CDS Start-End: 146-1267
gacgccttggaggacttggaacacctgtaacaggacaaggagttctgctcaggcacgtggccacagaaaactacttaggaagcctgtggtgagaacaacaacagtgcctgagaatcccacggctctggggaagtgagccccgaggatgaggctgctcgcctggctgattttcctggctaactggggaggtgccagggctgaaccagggaagttctggcacatcgctgacctgcaccttgaccctgactacaaggtatccaaagaccccttccaggtgtgcccatcagctggatcccagccagtgcccgacgcaggcccctggggtgactacctctgtgattctccctgggccctcatcaactcctccatctatgccatgaaggagattgagccagagccagacttcattctctggactggtgatgacacgcctcatgtgcccgatgagaaactgggagaggcagctgtactggaaattgtggaacgcctgaccaagctcatcagagaggtctttccagatactaaagtctatgctgctttgggaaatcatgattttcaccccaaaaaccagttcccagctggaagtaacaacatctacaatcagatagcagaactatggaaaccctggcttagtaatgagtccatcgctctcttcaaaaaaggtgccttctactgtgagaagctgccgggtcccagcggggctgggcgaattgtggtcctcaacaccaatctgtactataccagcaatgcgctgacagcagacatggcggaccctggccagcagttccagtggctggaagatgtgctgaccgatgcatccaaagctggggacatggtgtacattgtcggccacgtgcccccggggttctttgagaagacgcaaaacaaggcatggttccgggagggcttcaatgaaaaatacctgaaggtggtccggaagcatcatcgcgtcatagcagggcagttcttcgggcaccaccacaccgacagctttcggatgctctatgatgatgcaggtgtccccataagcgccatgttcatcacacctggagtcaccccatggaaaaccacattacctggagtggtcaatggggccaacaatccagccatccgggtgttcgaatatgaccgagccacactgagcctgaaggtcaggagtcctgcggaggccagaggaggagggtgggaggggcttaaatgcatcaccaccttccctcactctcagcttatccaccttcccctgaccactgagcctcaggaaggttgagctccttccacccttctccagctcaggatcagaaccctggaggcacctgccaccgagtcagggcagtgcctcaccaagtcaccttttcccctggatgactgtcacagcttcatacctggtctccctgcctctggccctgccctgctatggcccatccgctacacaagagagaagaaactaatctcctatagcaccactttcatcttgtctccgtcctgctcaaaaaccttcagtggctccccagtgccttcaagataaagttgtgtctccttgacctagta

SEQ ID NO: 185878 - DNA, 1878 bp, Homo sapiens
  Payload ID: 16598
  Gene Symbol: SMPDL3B
  Gene Name: sphingomyelin phosphodiesterase, acid-like 3B
  Uniprot ID: Q92485
  ENST ID: ENST00000373894
  CDS Start-End: 192-1559
ccagatcataccctgctgggcaaaggaggaagagccagaggatccagacgccttggaggacttggaacacctgtaacaggacaaggagttctgctcaggcacgtggccacagaaaactacttaggaagcctgtggtgagaacaacaacagtgcctgagaatcccacggctctggggaagtgagccccgaggatgaggctgctcgcctggctgattttcctggctaactggggaggtgccagggctgaaccagggaagttctggcacatcgctgacctgcaccttgaccctgactacaaggtatccaaagaccccttccaggtgtgcccatcagctggatcccagccagtgcccgacgcaggcccctggggtgactacctctgtgattctccctgggccctcatcaactcctccatctatgccatgaaggagattgagccagagccagacttcattctctggactggtgatgacacgcctcatgtgcccgatgagaaactgggagaggcagctgtactggaaattgtggaacgcctgaccaagctcatcagagaggtctttccagatactaaagtctatgctgctttgggaaatcatgattttcaccccaaaaaccagttcccagctggaagtaacaacatctacaatcagatagcagaactatggaaaccctggcttagtaatgagtccatcgctctcttcaaaaaaggtgccttctactgtgagaagctgccgggtcccagcggggctgggcgaattgtggtcctcaacaccaatctgtactataccagcaatgcgctgacagcagacatggcggaccctggccagcagttccagtggctggaagatgtgctgaccgatgcatccaaagctggggacatggtgtacattgtcggccacgtgcccccggggttctttgagaagacgcaaaacaaggcatggttccgggagggcttcaatgaaaaatacctgaaggtggtccggaagcatcatcgcgtcatagcagggcagttcttcgggcaccaccacaccgacagctttcggatgctctatgatgatgcaggtgtccccataagcgccatgttcatcacacctggagtcaccccatggaaaaccacattacctggagtggtcaatggggccaacaatccagccatccgggtgttcgaatatgaccgagccacactgagcctgaaggacatggtgacctacttcatgaacctgagccaggcgaatgctcaggggacgccgcgctgggagctcgagtaccagctgaccgaggcctatggggtgccggacgccagcgcccactccatgcacacagtgctggaccgcatcgctggcgaccagagcacactgcagcgctactacgtctataactcagtcagctactctgctggggtctgcgacgaggcctgcagcatgcagcacgtgtgtgccatgcgccaggtggacattgacgcttacaccacctgtctgtatgcctctggcaccacgcccgtgccccagctcccgctgctgctgatggccctgctgggcctgtgcacgctcgtgctgtgacctgccaggctcaccttcttcctggtaacgggtaacgggggcagcgcccaggatcacccagagctgggccttccaccatttcctccgcgcctgaggagtgaactgaaataggacaaccgaatcaggaagcgaagccccaggagctgcagccatccgtgatcgcgccactgcactccagcctgggtgacaaagccagactctctccaaaaacaaaccagaaacagaaaagaaatgacgacccaagacccccctacaagcatacttcttttgcgtattatgtttaactcacaaaacaaagctcatcatgcgtttgattctg

SEQ ID NO: 185879 - DNA, 953 bp, Homo sapiens
  Payload ID: 16598
  Gene Symbol: SMPDL3B
  Gene Name: sphingomyelin phosphodiesterase, acid-like 3B
  ENST ID: ENST00000411604
  CDS Start-End: 146-953
gacgccttggaggacttggaacacctgtaacaggacaaggagttctgctcaggcacgtggccacagaaaactacttaggaagcctgtggtgagaacaacaacagtgcctgagaatcccacggctctggggaagtgagccccgaggatgaggctgctcgcctggctgattttcctggctaactggggaggtgccagggctgaaccagaggaagcgcaaggaccatgtgcccaagagaaaggcaaagggcctcccccaacatccatcctggccagcctggctccgggcttggaagcagggaagttctggcacatcgctgacctgcaccttgaccctgactacaaggtatccaaagaccccttccaggtgtgcccatcagctggatcccagccagtgcccgacgcaggcccctggggtgactacctctgtgattctccctgggccctcatcaactcctccatctatgccatgaaggagattgagccagagccagacttcattctctggactggtgatgacacgcctcatgtgcccgatgagaaactgggagaggcagctgtactggaaattgtggaacgcctgaccaagctcatcagagaggtctttccagatactaaagtctatgctgctttgggaaatcatgattttcaccccaaaaaccagttcccagctggaagtaacaacatctacaatcagatagcagaactatggaaaccctggcttagtaatgagtccatcgctctcttcaaaaaaggtgccttctactgtgagaagctgccgggtcccagcggggctgggcgaattgtggtcctcaacaccaatctgtactataccagcaatgcgctgacagcagacatggcggaccctggccagcagttccagtggctggaagatgtgctgaccgatgcatccaaagctggggacatggtgtacattgtcggccacgtgcccccgg

SEQ ID NO: 185880 - DNA, 1913 bp, Homo sapiens
  Payload ID: 16598
  Gene Symbol: SMPDL3B
  Gene Name: sphingomyelin phosphodiesterase, acid-like 3B
  ENST ID: ENST00000548116
  CDS Start-End: 156-464
agaggatccagacgccttggaggacttggaacacctgtaacaggacaaggagttctgctcaggcacgtggccacagaaaactacttaggaagcctgtggtgagaacaacaacagtgcctgagaatcccacggctctggggaagtgagccccgaggatgaggctgctcgcctggctgattttcctggctaactggggaggtgccagggctgaaccagggaagttctggcacatcgctgacctgcaccttgaccctgactacaaggtatccaaagaccccttccaggtgtgcccatcagctggatcccagccagtgcccgacgcaggcccctggggtgactacctctgtgattctccctgggccctcatcaactcctccatctatgccatgaaggagattgagccagagccagacttcattctctggactggagctgtcccttccttttcttctgctgcttcctgagttgcctgccccaaattggcttggtggtgttttgtagtgatgacacgcctcatgtgcccgatgagaaactgggagaggcagctgtactggaaattgtggaacgcctgaccaagctcatcagagaggtctttccagatactaaagtctatgctgctttgggaaatcatgattttcaccccaaaaaccagttcccagctggaagtaacaacatctacaatcagatagcagaactatggaaaccctggcttagtaatgagtccatcgctctcttcaaaaaaggtgccttctactgtgagaagctgccgggtcccagcggggctgggcgaattgtggtcctcaacaccaatctgtactataccagcaatgcgctgacagcagacatggcggaccctggccagcagttccagtggctggaagatgtgctgaccgatgcatccaaagctggggacatggtgtacattgtcggccacgtgcccccggggttctttgagaagacgcaaaacaaggcatggttccgggagggcttcaatgaaaaatacctgaaggtggtccggaagcatcatcgcgtcatagcagggcagttcttcgggcaccaccacaccgacagctttcggatgctctatgatgatgcaggtgtccccataagcgccatgttcatcacacctggagtcaccccatggaaaaccacattacctggagtggtcaatggggccaacaatccagccatccgggtgttcgaatatgaccgagccacactgagcctgaaggacatggtgacctacttcatgaacctgagccaggcgaatgctcaggggacgccgcgctgggagctcgagtaccagctgaccgaggcctatggggtgccggacgccagcgcccactccatgcacacagtgctggaccgcatcgctggcgaccagagcacactgcagcgctactacgtctataactcagtcagctactctgctggggtctgcgacgaggcctgcagcatgcagcacgtgtgtgccatgcgccaggtggacattgacgcttacaccacctgtctgtatgcctctggcaccacgcccgtgccccagctcccgctgctgctgatggccctgctgggcctgtgcacgctcgtgctgtgacctgccaggctcaccttcttcctggtaacgggtaacgggggcagcgcccaggatcacccagagctgggccttccaccatttcctccgcgcctgaggagtgaactgaaataggacaaccgaatcaggaagcgaagccccaggagctgcagccatccgtgatcgcgccactgcactccagcctgggtgacaaagccagactctctccaaaaacaaaccagaaacagaaaagaaatgacgacccaagacccccctacaagcatacttcttttgcgtattatgtttaactcacaaaacaaagctcatcatgcgtttgattctg

SEQ ID NO: 185881 - DNA, 1611 bp, Homo sapiens
  Payload ID: 16598
  Gene Symbol: SMPDL3B
  Gene Name: sphingomyelin phosphodiesterase, acid-like 3B
  ENST ID: ENST00000549094
  CDS Start-End: 75-1298
tacttaggaagcctgtggtgagaacaacaacagtgcctgagaatcccacggctctggggaagtgagccccgaggatgaggctgctcgcctggctgattttcctggctaactggggaggtgccagggctgaaccagggaagttctggcacatcgctgacctgcaccttgaccctgactacaaggtatccaaagaccccttccaggtgtgcccatcagctggatcccagccagtgcccgacgcaggcccctggggtgactacctctgtgattctccctgggccctcatcaactcctccatctatgccatgaaggagattgagccagagccagacttcattctctggactggtgatgacacgcctcatgtgcccgatgagaaactgggagaggcagctgtactggaaattgtggaacgcctgaccaagctcatcagagaggtctttccaggtgccttctactgtgagaagctgccgggtcccagcggggctgggcgaattgtggtcctcaacaccaatctgtactataccagcaatgcgctgacagcagacatggcggaccctggccagcagttccagtggctggaagatgtgctgaccgatgcatccaaagctggggacatggtgtacattgtcggccacgtgcccccggggttctttgagaagacgcaaaacaaggcatggttccgggagggcttcaatgaaaaatacctgaaggtggtccggaagcatcatcgcgtcatagcagggcagttcttcgggcaccaccacaccgacagctttcggatgctctatgatgatgcaggtgtccccataagcgccatgttcatcacacctggagtcaccccatggaaaaccacattacctggagtggtcaatggggccaacaatccagccatccgggtgttcgaatatgaccgagccacactgagcctgaaggacatggtgacctacttcatgaacctgagccaggcgaatgctcaggggacgccgcgctgggagctcgagtaccagctgaccgaggcctatggggtgccggacgccagcgcccactccatgcacacagtgctggaccgcatcgctggcgaccagagcacactgcagcgctactacgtctataactcagtcagctactctgctggggtctgcgacgaggcctgcagcatgcagcacgtgtgtgccatgcgccaggtggacattgacgcttacaccacctgtctgtatgcctctggcaccacgcccgtgccccagctcccgctgctgctgatggccctgctgggcctgtgcacgctcgtgctgtgacctgccaggctcaccttcttcctggtaacgggtaacgggggcagcgcccaggatcacccagagctgggccttccaccatttcctccgcgcctgaggagtgaactgaaataggacaaccgaatcaggaagcgaagccccaggagctgcagccatccgtgatcgcgccactgcactccagcctgggtgacaaagccagactctctccaaaaacaaaccagaaacagaaaagaaatgacgacccaagacccccctacaagcatacttcttttgcgtattatgtttaactcacaaaacaaagctcatcatgcgtttg

SEQ ID NO: 185882 - DNA, 3744 bp, Homo sapiens
  Payload ID: 16599
  Gene Symbol: SGMS1
  Gene Name: sphingomyelin synthase 1
  ENST ID: ENST00000361781
  CDS Start-End: 961-2202
tcgggcagcggactgggcatgctcggcagcccgggaggctcgcggtggcaagtcgaaagcgttcgcaccagcggggcagcggctgcgggcggcaggcggcgggcaggtcgggagtgagaaggaccggcctgggctgactgctctcccctcgcgcctagggagccggtcggagagcgcgattggggtgcggagccccgacgctgccctgccccggatttcattccgcggcgggggctccgcgagcggaattccggcggctgccgtgactccagtgcaacgtgacgacagcatgtacgatccctgaatgggcccgtgggcatatttagtcattcatttttgatcaggagaaagaagacagccatcatttgaaaggtaaagcttcagcgactgaaggagtgtggactttttgaatttcaagaacagtaaagttggaacacagcagagggtgtgtaataaaatacagattggaaagaagactgatgaagaaaaataacagcatgattcaggcacaccattgagttctttgggatgcccgaaagtgtctggttgggaaacatgaaatagaagacgagaacctgcctcagcaagcgtacctgagaatacttttaaaggaacctgttgataaatgcaaaacagtggctgttgcaggtgatggaactgtactggaacaatgggagaagctggtagcttataggaagccaagatgaccagaatgtttttaaataatccaaggaagaatcctgctcaaaaatgaggtgaattaatacttgggcgctcaggaaccctggacagctacatgaggtgtttaaaaactgccctgaccatcttgccaaacaagtctctgctcatgaggccccacaggatgaacgagccgaggcaggacagtgtcctgccctgtcggaacagtgactgctgacctgccaagagagagctggggactgcctgctgtctgccagtacaatgaaggaagtggtttattggtcacccaagaaggtggcagactggctgctggagaatgctatgccagaatactgtgagcctctggagcatttcacaggccaggacttgatcaacctaacccaagaggatttcaaaaaaccccccttgtgccgagtctcctctgacaatgggcagcggctcctggacatgatagaaaccctgaaaatggagcaccatttggaagcacacaagaacggccatgccaatgggcacctcaacattggcgtagacatccccacccccgacggcagcttcagcatcaagattaaacccaacgggatgccaaatgggtataggaaagagatgataaagatccccatgccagaactggagcgctctcagtaccccatggagtggggcaagacttttctggcctttctttatgcactttcctgtttcgttctcaccacagtgatgatctcggtcgtccacgaacgagtacctcctaaggaggtgcagcctccactaccggacacattttttgaccattttaaccgggtgcagtgggccttttctatttgtgaaattaatggcatgatccttgtaggactctggttaattcagtggctgctcttaaaatacaagtctattattagcagaagatttttctgcatagttggcacgctgtacctgtatcggtgtattacaatgtatgtaactacactcccagtacctggtatgcatttcaactgttctccgaagcttttcggagactgggaagcccaactgcgaagaataatgaagctcattgctggaggtggcttgtctatcactggctctcacaacatgtgtggggactatctgtacagcggccacacggtcatgctaacacttacctacttatttatcaaagagtattcccctcggcgactctggtggtatcactggatttgctggcttctcagcgtagttggaatcttctgtattctcttagcgcatgaccactacactgtggacgtggtggtggcatattacatcaccacgagactcttctggtggtatcacactatggccaatcagcaagtgctaaaggaagcttcccagatgaacctcctggccagggtgtggtggtacaggccatttcagtactttgaaaagaatgtccaaggaattgtacctcgatcttaccattggcctttcccctggccagtagtccacctcagtaggcaagttaaatacagccggctggtgaatgacacataacagctgtacaaagtggggaaaagacaaattgtccgaagtgctaagaactccatgagagaagatgccataaaataaacacctccctaatcctattatctttcaatggttaccttgacttaacctattgagttacctggtcagcactgtgatctttttttctctccaaaggacctgcgttggacaacaataaagaaaaatttaacctatcatgcactgtacacatttcctgttcataagtttgggatttacataacccgcaaccaccatgttcctttgtatatgatgcagcagcataaatgtaagcttttatatcataagttctggtctttccagtcacatctggaaataaagcgtattattttcttgggaaaacatacttttcatatctcttgccccaaagattgggctgtaagccattttctagcaaatgtctctatgaaggtttctaagtacctgaatggggtttgattctgaaatctttctacctgttgcaccgatattcaaataaaaatgatagacacagaaaggtttggtaactttgggttttgtaaaatcagcaaaggcagtgtttcaaaaagtgcaaaaaaaaagattctgttataaagtgattttctaagtatttcctaactttatttttcaaaatgatgttatgaacaccaaatttaaagatttttaacatgtcagagagaagagagttaaaatttaaaaatgcatcttgggagagaaatttgtctatgtttctagtgcctttcttgtcttgattgtatggtcagtaggcaatcttaaatgtttttatttaaaataaagtattccttgaaaatataaatatatgtatacactactaaattttgcatttatagctaaattgaatcagaagactgcttatggttttaaaattgcaatgacttaaataatgaggttgttaattagagtcagagcctgttcacatattgtgatcaggtagcaatgacatgtaccacttaaattattttatcgtcgatttggtagttcaattttaactactcaatgaaaacagccatgaatatcttttcttaaagagagttttgaaaatgatcacttacctaaaacttgaaagctatgaattagttatccatactctcatgacaattttgttggtgaacaacaaaaaagagatctatttctttaaaagatatttgtgcagaaactgcatgtaactctaagttttactcctaacatacatatgtttggggaagtattctattctatacttgccaatgtggagaacaaaatagttttttaagaatgaagaagtatatatatccattctgtattttacgtgcagcagaattatcttccgtaggatttttttgtgtattcacaaggtgatatttgtattgtaaaacaataatggtgaaggaaataaaaaggcttttaaaattttgtttgttttaaatctttgtaaagttattattccagagagtatactggtatcttacagcttacctagatcataaattaatcaaaatgcactttttaataaaaactgatacttaaaataaa

SEQ ID NO: 185883 - DNA, 1096 bp, Homo sapiens
  Payload ID: 16599
  Gene Symbol: SGMS1
  Gene Name: sphingomyelin synthase 1
  ENST ID: ENST00000361543
  CDS Start-End: 133-858
gccaaacaagtctctgctcatgaggccccacaggatgaacgagccgaggcaggacagtgtcctgccctgtcggaacagtgactgctgacctgccaagagagagctggggactgcctgctgtctgccagtacaatgaaggaagtggtttattggtcacccaagaaggtggcagactggctgctggagaatgctatgccagaatactgtgagcctctggagcatttcacaggccaggacttgatcaacctaacccaagaggatttcaaaaaaccccccttgtgccgagtctcctctgacaatgggcagcggctcctggacatgatagaaaccctgaaaatggagcaccatttggaagcacacaagaacggccatgccaatgggcacctcaacattggcgtagacatccccacccccgacggcagcttcagcatcaagattaaacccaacgggatgccaaatgggtataggaaagagatgataaagatccccatgccagaactggagcgctctcagtaccccatggagtggggcaagacttttctggcctttctttatgcactttcctgtttcgttctcaccacagtgatgatctcggtcgtccacgaacgagtacctcctaaggaggtgcagcctccactaccggacacattttttgaccattttaaccgggtgcagtgggccttttctatttgtgaaattaatggcatgatccttgtaggactctggttaattcagtggctgctcttaaaatacaaggatgtgggaaatgaaagcagagtcgtcatgatcttcctaagcatcgtccaccctgtccttctactggggtccatcgctggtttcctgtctctctccctgtgacctctcttcagtgtatctggcccaccagacaggtaggaggtaggaagaaagatacagatgacacatcaagcagtgaagatggataaactaccttttcctggctctcatagagaagaattggactttcaagccactgactaggaaaaattcctgggaaatctctgcatttgtgtcagacttcactgcaaaacaggtctattattagcagaagatttttctgcatagttggcacgctgta

SEQ ID NO: 185884 - DNA, 3634 bp, Homo sapiens
  Payload ID: 16599
  Gene Symbol: SGMS1
  Gene Name: sphingomyelin synthase 1
  ENST ID: ENST00000429490
  CDS Start-End: 955-1614
agcggactgggcatgctcggcagcccgggaggctcgcggtggcaagtcgaaagcgttcgcaccagcggggcagcggctgcgggcggcaggcggcgggcaggtcgggagtgagaaggaccggcctgggctgactgctctcccctcgcgcctagggagccggtcggagagcgcgattggggtgcggagccccgacgctgccctgccccggatttcattccgcggcgggggctccgcgagcggaattccggcggctgccgtgactccagtgcaacgtgacgacagcatgtacgatccctgaatgggcccgtgggcatatttagtcattcatttttgatcaggagaaagaagacagccatcatttgaaaggtaaagcttcagcgactgaaggagtgtggactttttgaatttcaagaacagtaaagttggaacacagcagagggtgtgtaataaaatacagattggaaagaagactgatgaagaaaaataacagcatgattcaggcacaccattgagttctttgggatgcccgaaagtgtctggttgggaaacatgaaatagaagacgagaacctgcctcagcaagcgtacctgagaatacttttaaaggaacctgttgataaatgcaaaacagtggctgttgcaggtgatggaactgtactggaacaatgggagaagctggtagcttataggaagccaagatgaccagaatgtttttaaataatccaaggaagaatcctgctcaaaaatgaggtgaattaatacttgggcgctcaggaaccctggacagctacatgaggtgtttaaaaactgccctgaccatcttgccaaacaagtctctgctcatgaggccccacaggatgaacgagccgaggcaggacagtgtcctgccctgtcggaacagtgactgctgacctgccaagagagagctggggactgcctgctgtctgccagtacaatgaaggaagtggtttattggtcacccaagaaggtggcagactggctgctggagaatgctatgccagaatactgtgagcctctggagcatttcacaggccaggacttgatcaacctaacccaagaggatttcaaaaaaccccccttgtgccgagtctcctctgacaatgggcagcggctcctggacatgatagaaaccctgaaaatggagcaccatttggaagcacacaagaacggccatgccaatgggcacctcaacattggcgtagacatccccacccccgacggcagcttcagcatcaagattaaacccaacgggatgccaaatgggtataggaaagagatgataaagatccccatgccagaactggagcgctctcagtaccccatggagtggggcaagacttttctggcctttctttatgcactttcctgtttcgttctcaccacagtgatgatctcggtcgtccacgaacgagtacctcctaaggaggtgcagcctccactaccggacacattttttgaccattttaaccgggtgcagtgggccttttctatttgtgaaattaatggcatgatccttgtaggactctggttaattcagtggctgctcttaaaatacaacttttcggagactgggaagcccaactgcgaagaataatgaagctcattgctggaggtggcttgtctatcactggctctcacaacatgtgtggggactatctgtacagcggccacacggtcatgctaacacttacctacttatttatcaaagagtattcccctcggcgactctggtggtatcactggatttgctggcttctcagcgtagttggaatcttctgtattctcttagcgcatgaccactacactgtggacgtggtggtggcatattacatcaccacgagactcttctggtggtatcacactatggccaatcagcaagtgctaaaggaagcttcccagatgaacctcctggccagggtgtggtggtacaggccatttcagtactttgaaaagaatgtccaaggaattgtacctcgatcttaccattggcctttcccctggccagtagtccacctcagtaggcaagttaaatacagccggctggtgaatgacacataacagctgtacaaagtggggaaaagacaaattgtccgaagtgctaagaactccatgagagaagatgccataaaataaacacctccctaatcctattatctttcaatggttaccttgacttaacctattgagttacctggtcagcactgtgatctttttttctctccaaaggacctgcgttggacaacaataaagaaaaatttaacctatcatgcactgtacacatttcctgttcataagtttgggatttacataacccgcaaccaccatgttcctttgtatatgatgcagcagcataaatgtaagcttttatatcataagttctggtctttccagtcacatctggaaataaagcgtattattttcttgggaaaacatacttttcatatctcttgccccaaagattgggctgtaagccattttctagcaaatgtctctatgaaggtttctaagtacctgaatggggtttgattctgaaatctttctacctgttgcaccgatattcaaataaaaatgatagacacagaaaggtttggtaactttgggttttgtaaaatcagcaaaggcagtgtttcaaaaagtgcaaaaaaaaagattctgttataaagtgattttctaagtatttcctaactttatttttcaaaatgatgttatgaacaccaaatttaaagatttttaacatgtcagagagaagagagttaaaatttaaaaatgcatcttgggagagaaatttgtctatgtttctagtgcctttcttgtcttgattgtatggtcagtaggcaatcttaaatgtttttatttaaaataaagtattccttgaaaatataaatatatgtatacactactaaattttgcatttatagctaaattgaatcagaagactgcttatggttttaaaattgcaatgacttaaataatgaggttgttaattagagtcagagcctgttcacatattgtgatcaggtagcaatgacatgtaccacttaaattattttatcgtcgatttggtagttcaattttaactactcaatgaaaacagccatgaatatcttttcttaaagagagttttgaaaatgatcacttacctaaaacttgaaagctatgaattagttatccatactctcatgacaattttgttggtgaacaacaaaaaagagatctatttctttaaaagatatttgtgcagaaactgcatgtaactctaagttttactcctaacatacatatgtttggggaagtattctattctatacttgccaatgtggagaacaaaatagttttttaagaatgaagaagtatatatatccattctgtattttacgtgcagcagaattatcttccgtaggatttttttgtgtattcacaaggtgatatttgtattgtaaaacaataatggtgaaggaaataaaaaggcttttaaaattttgtttgttttaaatctttgtaaagttattattccagagagtatactggtatcttacagcttacctagatcataaattaatcaaaatgcactttttaataaaaactgatacttaaaataaatggctgttatttct

SEQ ID NO: 185885 - DNA, 461 bp, Homo sapiens
  Payload ID: 16599
  Gene Symbol: SGMS1
  Gene Name: sphingomyelin synthase 1
  ENST ID: ENST00000602619
  CDS Start-End: 355-461
attaaacataggttttgattttttttgtacttaaatttttcctcctttcattcttaatgtctcccctgcatatctgtatgtatatatgtttatatatacgtaaatccacatgggatttccatgacctctcaaaatggaaagcaacaataatgcctgtccttgagaacttttttggtttttacaattgtaaataatgttgtctccccatttagaattggactttcaagccactgactaggaaaaattcctgggaaatctctgcatttgtgtcagacttcactgcaaaacaggtctattattagcagaagatttttctgcatagttggcacgctgtacctgtatcggtgtattacaatgtatgtaactacactcccagtacctggtatgcatttcaactgttctccgaagcttttcggagactgggaagcccaactgcgaagaataatgaagctcattgctgg

SEQ ID NO: 185886 - DNA, 1333 bp, Homo sapiens
  Payload ID: 16599
  Gene Symbol: SGMS1
  Gene Name: sphingomyelin synthase 1
  ENST ID: ENST00000602565
  CDS Start-End: 1-39
ctctggttaattcagtggctgctcttaaaatacaagtaagtcaagtaaaagctctaagattcaatgattatgggatttgcactccaaacatctacttattatttataaatgaaatttatcaacttgttgggatcaaaacatactatttttttttcttttttaaacacataccctgttggactaacttactgtctggaagctttaaaagaaaatgttgtttgttgcctgttttatgcaagattcatacaggatgatgaataagatggttagagatgatgctctgttttcacttaataagaaagaaaactctcagacatcttcagacagtacaggctattgaacaacagatcaaccacctagtcttggttggtgttactaacccattaaataaatcgacagttggcctaagcactataaattggctgcatagcttttcccacacagagtcagacatctagagccttagcaatatgtatttaaagatgtttcacacagaattcagaacacctgttccagagtggcttgggttgttgggaaaacaataccaaagggtatgcctttgggtaggtgggaagtggatggacctgaatggattcccaccttctactactactacttaaaacaatatgtgactgttgcattcaaatttctcagagttttaagtaggcaactcccacttagttccaggtgtatccaaggtggctttcatatctgaagctctaaactcaacatggaccccctcagactggctgtttactggggttgcctacattgtcccttcactgatgtttgattttctccttagttaaaggaacgccttatggtttccatgaatgagggttggaaattggtttgttaaagagctgagtttctctccagtggagtgtgtttcatgatccaccatgtggttaaatattaaggaattcatcttacagcaagaaaacaaaatgcacactgagagttcatgctgaatgttctttgacagaaatgataaggtttttcctagtatgttttataacaactcttttttttaacctgataaattatatatctacaaattgaaataaaagcagttcctgacactttcccagggatggacggtcttaactggtataaagaaagccatttaactgatcagtgtttatttacagatggtttgacagtcctagagtttaagctgaatctgaaatagaattgttggtctgggctgcatttaatttggtggaagacgtttttttctgttcctttggttttaagaggctaataaataggaataggctttagaaatacaagatacttggagtttattaaatgcattatttttgctgccaaa

SEQ ID NO: 185887 - DNA, 1680 bp, Homo sapiens
  Payload ID: 16599
  Gene Symbol: SGMS1
  Gene Name: sphingomyelin synthase 1
  ENST ID: ENST00000619438
  CDS Start-End: 955-1680
agcggactgggcatgctcggcagcccgggaggctcgcggtggcaagtcgaaagcgttcgcaccagcggggcagcggctgcgggcggcaggcggcgggcaggtcgggagtgagaaggaccggcctgggctgactgctctcccctcgcgcctagggagccggtcggagagcgcgattggggtgcggagccccgacgctgccctgccccggatttcattccgcggcgggggctccgcgagcggaattccggcggctgccgtgactccagtgcaacgtgacgacagcatgtacgatccctgaatgggcccgtgggcatatttagtcattcatttttgatcaggagaaagaagacagccatcatttgaaaggtaaagcttcagcgactgaaggagtgtggactttttgaatttcaagaacagtaaagttggaacacagcagagggtgtgtaataaaatacagattggaaagaagactgatgaagaaaaataacagcatgattcaggcacaccattgagttctttgggatgcccgaaagtgtctggttgggaaacatgaaatagaagacgagaacctgcctcagcaagcgtacctgagaatacttttaaaggaacctgttgataaatgcaaaacagtggctgttgcaggtgatggaactgtactggaacaatgggagaagctggtagcttataggaagccaagatgaccagaatgtttttaaataatccaaggaagaatcctgctcaaaaatgaggtgaattaatacttgggcgctcaggaaccctggacagctacatgaggtgtttaaaaactgccctgaccatcttgccaaacaagtctctgctcatgaggccccacaggatgaacgagccgaggcaggacagtgtcctgccctgtcggaacagtgactgctgacctgccaagagagagctggggactgcctgctgtctgccagtacaatgaaggaagtggtttattggtcacccaagaaggtggcagactggctgctggagaatgctatgccagaatactgtgagcctctggagcatttcacaggccaggacttgatcaacctaacccaagaggatttcaaaaaaccccccttgtgccgagtctcctctgacaatgggcagcggctcctggacatgatagaaaccctgaaaatggagcaccatttggaagcacacaagaacggccatgccaatgggcacctcaacattggcgtagacatccccacccccgacggcagcttcagcatcaagattaaacccaacgggatgccaaatgggtataggaaagagatgataaagatccccatgccagaactggagcgctctcagtaccccatggagtggggcaagacttttctggcctttctttatgcactttcctgtttcgttctcaccacagtgatgatctcggtcgtccacgaacgagtacctcctaaggaggtgcagcctccactaccggacacattttttgaccattttaaccgggtgcagtgggccttttctatttgtgaaattaatggcatgatccttgtaggactctggttaattcagtggctgctcttaaaatacaaggatgtgggaaatgaaagcagagtcgtcatgatcttcctaagcatcgtccaccctgtccttctactggggtccatcgctggtttcctgtctctctccctgtga

SEQ ID NO: 185888 - DNA, 1013 bp, Homo sapiens
  Payload ID: 16599
  Gene Symbol: SGMS1
  Gene Name: sphingomyelin synthase 1
  ENST ID: ENST00000626236
  CDS Start-End: 133-858
gccaaacaagtctctgctcatgaggccccacaggatgaacgagccgaggcaggacagtgtcctgccctgtcggaacagtgactgctgacctgccaagagagagctggggactgcctgctgtctgccagtacaatgaaggaagtggtttattggtcacccaagaaggtggcagactggctgctggagaatgctatgccagaatactgtgagcctctggagcatttcacaggccaggacttgatcaacctaacccaagaggatttcaaaaaaccccccttgtgccgagtctcctctgacaatgggcagcggctcctggacatgatagaaaccctgaaaatggagcaccatttggaagcacacaagaacggccatgccaatgggcacctcaacattggcgtagacatccccacccccgacggcagcttcagcatcaagattaaacccaacgggatgccaaatgggtataggaaagagatgataaagatccccatgccagaactggagcgctctcagtaccccatggagtggggcaagacttttctggcctttctttatgcactttcctgtttcgttctcaccacagtgatgatctcggtcgtccacgaacgagtacctcctaaggaggtgcagcctccactaccggacacattttttgaccattttaaccgggtgcagtgggccttttctatttgtgaaattaatggcatgatccttgtaggactctggttaattcagtggctgctcttaaaatacaaggatgtgggaaatgaaagcagagtcgtcatgatcttcctaagcatcgtccaccctgtccttctactggggtccatcgctggtttcctgtctctctccctgtgacctctcttcagtgtatctggcccaccagacagaattggactttcaagccactgactaggaaaaattcctgggaaatctctgcatttgtgtcagacttcactgcaaaacaggtctattattagcagaagatttttctgcatagttggcacgctgta

SEQ ID NO: 185889 - DNA, 1887 bp, Homo sapiens
  Payload ID: 16600
  Gene Symbol: SGMS2
  Gene Name: sphingomyelin synthase 2
  Uniprot ID: Q8NHU3
  ENST ID: ENST00000359079
  CDS Start-End: 390-1487
agctaccttataaagaccatctgtacatccactgtgaaatggagtttcaaaatcacaagcttctttcccacatgaacataagactaggagcacatatggaagagtaaagttgaagggaatttggatgatgatttggcaagatgctgtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactaggggacaatggatatcatagagacagcaaaacttgaagaacatttggaaaatcaacccagtgatcctacgaacacttatgcaagacccgctgaacctgttgaagaagaaaacaaaaatggcaatggtaaacccaagagcttatccagtgggctgcgaaaaggcaccaaaaagtacccggactatatccaaattgctatgcccactgaatcaaggaacaaatttccactagagtggtggaaaacgggcattgccttcatatatgcagttttcaacctcgtcttgacaaccgtcatgatcacagttgtacatgagagggtccctcccaaggagcttagccctccactcccagacaagttttttgattacattgatagggtgaaatgggcattttctgtatcagaaataaatgggattatattagttggattatggatcacccagtggctgtttctgagatacaagtcaatagtgggacgcagattctgttttattattggaactttatacctgtatcgctgcattacaatgtatgttactactctacctgtgcctggaatgcatttccagtgtgctccaaagctcaatggagactctcaggcaaaagttcaacggattctacgattgatttctggtggtggattgtccataactggatcacatatcttatgtggagacttcctcttcagcggtcacacggttacgctgacactgacttatttgttcatcaaagaatattcgcctcgtcacttctggtggtatcatttaatctgctggctgctgagtgctgccgggatcatctgcattcttgtagcacacgaacactacactatcgatgtgatcattgcttattatatcacaacacgactgttttggtggtaccattcaatggccaatgaaaagaacttgaaggtctcttcacagactaatttcttatctcgagcatggtggttccccatcttttatttttttgagaaaaatgtacaaggctcaattccttgctgcttctcctggccgctgtcttggcctcctggctgcttcaaatcatcatgcaaaaagtattcacgggttcagaagattggtgaagacaatgagaaatcgacctgaggagcaaaacaaaggcatcagctcttacaccaaaagagttaacgctgtaaccaaaggtatagttttgttttttattttaggagaactgactggtaaatgaagaaatggaccaaattttgtgtaaacgattagaaagatgaacaaagtattgccctttgactggttttcttcttcatcctgagaaagatacattctcttgcagctcttcattcattggtgacaagcccccaccccgggactttactaatgagcttgttaaagaggtgccaaagaacatattcctcctttctttattctttctccaccaaaaccctctacttcagaattttttcaggatatttttcagcccaaggtcagaagaatgtgttaatattttaaataaaatatctggacatctaca

SEQ ID NO: 185890 - DNA, 6149 bp, Homo sapiens
  Payload ID: 16600
  Gene Symbol: SGMS2
  Gene Name: sphingomyelin synthase 2
  Uniprot ID: Q8NHU3
  ENST ID: ENST00000394684
  CDS Start-End: 558-1655
agattgatctctgttgccgctcagggaggtcagctccaggccctcagcctttcggccgggagccaaactgccctgcctgccaagcccctccttctctgcaccttaaacagccgcgaggggagagtcggctgggattttcttcttaagaagtcgcgcaggtttttcgagctccactctgcgccaggagagccacggcagcaggaacgggcactgctgccaccgggccgacggagctgcatcctgtggccctataacactcttctccaaaaggacctgccagagactgggagtgttgactgctgcaaggaccaaggtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactaggggacaatggatatcatagagacagcaaaacttgaagaacatttggaaaatcaacccagtgatcctacgaacacttatgcaagacccgctgaacctgttgaagaagaaaacaaaaatggcaatggtaaacccaagagcttatccagtgggctgcgaaaaggcaccaaaaagtacccggactatatccaaattgctatgcccactgaatcaaggaacaaatttccactagagtggtggaaaacgggcattgccttcatatatgcagttttcaacctcgtcttgacaaccgtcatgatcacagttgtacatgagagggtccctcccaaggagcttagccctccactcccagacaagttttttgattacattgatagggtgaaatgggcattttctgtatcagaaataaatgggattatattagttggattatggatcacccagtggctgtttctgagatacaagtcaatagtgggacgcagattctgttttattattggaactttatacctgtatcgctgcattacaatgtatgttactactctacctgtgcctggaatgcatttccagtgtgctccaaagctcaatggagactctcaggcaaaagttcaacggattctacgattgatttctggtggtggattgtccataactggatcacatatcttatgtggagacttcctcttcagcggtcacacggttacgctgacactgacttatttgttcatcaaagaatattcgcctcgtcacttctggtggtatcatttaatctgctggctgctgagtgctgccgggatcatctgcattcttgtagcacacgaacactacactatcgatgtgatcattgcttattatatcacaacacgactgttttggtggtaccattcaatggccaatgaaaagaacttgaaggtctcttcacagactaatttcttatctcgagcatggtggttccccatcttttatttttttgagaaaaatgtacaaggctcaattccttgctgcttctcctggccgctgtcttggcctcctggctgcttcaaatcatcatgcaaaaagtattcacgggttcagaagattggtgaagacaatgagaaatcgacctgaggagcaaaacaaaggcatcagctcttacaccaaaagagttaacgctgtaaccaaaggtatagttttgttttttattttaggagaactgactggtaaatgaagaaatggaccaaattttgtgtaaacgattagaaagatgaacaaagtattgccctttgactggttttcttcttcatcctgagaaagatacattctcttgcagctcttcattcattggtgacaagcccccaccccgggactttactaatgagcttgttaaagaggtgccaaagaacatattcctcctttctttattctttctccaccaaaaccctctacttcagaattttttcaggatatttttcagcccaaggtcagaagaatgtgttaatattttaaataaaatatctggacatctacagccactgtgtaaatagaactgcctaatgttgagagtggtttttagcattaggtttagcaagggggagatccgtgggttgtgcgtcagctttgggtgaattttgtttctaccctgtcacggggaaagttcgggttgagtccaggagtgcacactgctgctgccacccaatgcgctacatatcacttttttttgttttgttttgttttgtttttaaaagatcattttatcttaaaaaggaaagctgatccaagtaaacacgaaagtatttgacacaccccacagattttacatgtgtgtaaatgtttcactttaaaatctctatgacagatacacaggaaacatgagatggtttctgctaatgagtggcccttgagtacacacttagatgctgtctgccctgtaaatttggatctggtgccccagggcagtcaactcttctagcacaggctgaaaacacgtgtgtgtcaactgaggttcacaccacttggggaatgagcctgttttctttccaggtcaggccctggtgtgagatcaattttagggctcctaattggagcacagaaatgtatttggtcaaatttcattgaaggtgatttcttcctttttctgttgtactttatggaaaaaccaagatggaacctgaaagttaatgtatccttgcttttagcaagagactcagtttcttataactagtcctaaggacatatgccgcaattgagtaattttacttttaccctatgaaaataacatggtgctgcactataatatactctcggaatcagtgtgttagttacagctatacagtgaagggggataactgtttctaaatttctttaaggtgatgccaaaaaatggattaaaaaatctgatcagatttaatgttaccagatttagtgcattatttaatgctattggatcttttggataattcttggcttaatttcttagctacttgaaggttaatttgcaagacttttaaaaccttagaaaagttttaaggttgcaaagttatcaacactggggcagagggtggagaggccaatgcgggtagaaggaggcagttatgtttatattgaaggtgaaatttttctttcatttagaatggaaaacatccccaaatgtatcattataaactagtcagccttgactacacaaaattgacctttaagttgcttgagaaaaacacaatgcaaatcgttcagaagggtcaacatcctttggtgctaaaatcttgtgtatgttttcagaatggctttttctgtatgttatagaataatcactaaaggaaaggtagttgaatttaaagtcatgaagcaagactctttaattcagttattttaaacaagaattaaaaccccaaacatccttggcaggctttgaagcacacagaattttctagtatttcttattaaatacaccaataataaacatatacttagtttacctgatgagtttagacataattctatataatgttcgcttatattcatttattaactagcaacacttgtgcaagaacaaggtattctgcttgaaaacactgatttttaagttcctgttgcccgattgtaaagaaaatcatctgacacagaagcctggattttgctctcctaacactggtgttttccttgagcctctaattcaaataaaacaaactgatacaccttacagccttattcatctgtgtctggataactcacttttcatctattgaataagaaaaagtgtttaaacttaataaaataaaaaattgtgcaccaattactacagatccttgaaacagtaagccttggattttagtcaagtaatccagtttttttttaatttaaaaaaaaccatcaccttttaaagaactttaaaaacacctgtgatgccaatgtggacattgccgctgccatgtctttacacgcatgtgtcgtatagctctgtcatcgagttgaggaagtccatggtttgcaaataagggtgggggaatcaaaatttcaagatggaaaaataaaacaaatagtaaaacccatttacatgtaggaaagaaaagttgagcttcaacccaatgtgccactttgatataaaacaagtatgatatatatataaactgaagatataaaacaagtatgatcttgcctttgaaatcataaatgtttggggtacctgttctttgccagttaagatacatatcttattatctttgtttttttcaagtctatgctcctgtttgaagcttttcctgtaatttaggttgtctgtgaaatacctataacatataattcctatagagtatgccacattttttttctaactcatttcaaatgaaattctctcagattctagtttttgagcttgtccactagatctgaaaataaagcatcctttcctgagtccacttgaactaattgtgaatttgttacttaatttactggcatcttgggaaacaagttttgctgtggcaggaaggctgttttgagagtgagcgttgagtctactctggtttgtggatgacattgcattagggttatttcctgtattaccagtgcccccttgtggcaatatactttatgacttggaatgcaaacaccacttttaaaagcctgttttcaagtttttgaaaggcatttgttttctgttgtttgccaataatctgaaagtatcatgtgaaaggaattattttaaaagcattttaaacctttcccaaaggtaaaatgtgctcagattataggcacttgtaattctaaccttgtatccatttgatcaaagaaaatttgtagaacatttttacctctcatgatcacaatcattagtgtctccctttataacgacctatgttttgtttactttgaaacaccaaatttgttgtcttggttttttttacatgacagaactcatgcagtttcttttttagttgaaagttcacatcttgccccttgaatagtttgaacatttctttcttaattcttttttgtttttgttttgcactgtaaaactgatgaaaactttaagccaatcttaatgcactagcctctgtagtgtaaggaagtgtgagaaggagtttcttaatgagtttacacgtttaaatcaagcatattataagttatatgccatgtgttgaaggcttttctatttatatatataaagatttttagtatttgtttttagtgtccttgtgttgcaataatttaactcctttgactcagttgctgaaaatatttcttctattaagaagtgctcttgacttcaacacccaaacactgaaaatcatgtcaatgttacccaaagataagtttttatacagatacacaccttataagttctgatttattttcttactcattatgctgtgttctaaataaatcatgaatgagaagagtgctttattgtgaaattatttaaaactgtcctttaaaagaaaaagaggaaacgatgaacaaaaactaatctaattgccaagttagaattcattatttaatttacctcctatgcaatgattaatgctgcaaaatgtatggttatgttaccgtatattcacaaaagaaatattattacaaggtttcagaggtagccaattgcattcttttggaaatttactgtactgtttcaatgtgttaagtgccttgttgtaaagtaaaattttaagtctagattcattattttcctgacatatatttttcattatgatatctactgtatgctattgtgatagttttatgaaatgcttacattttaatcaaatatgtaaatttcagaagctcttttttcctacccaccagtaccttaatcattggtttatcacattggattcaaattcaggttccttttttgataaagaggaaatttgttttccatgcttgtgattttgtgtttgtaaacatttcaggaggaatttaggagtgtaactatagtttatacttctataatgttgtcttacatttacatttttaagtgcctaattgttaaaactgatttatgtttctcttctaaagaggatatgtgtacttggtttctaatctctttggttttgctttttaaaaaatgcaagagcctatactttgtatttacctaataaaccacagtgacatcaacagtcttttcaaaattaa

SEQ ID NO: 185891 - DNA, 2127 bp, Homo sapiens
  Payload ID: 16600
  Gene Symbol: SGMS2
  Gene Name: sphingomyelin synthase 2
  Uniprot ID: Q8NHU3
  ENST ID: ENST00000394686
  CDS Start-End: 630-1727
aaatggagtttcaaaatcacaagcttctttcccacatgaacataagactaggagcacatatggaagagtaaagttgaagggaatttggatgatgatttggcaagatgctgtaagtggattaggcaaggctgctaaagagagacaggaaatggctgtgttagtgcttcggacctccgttagaagtagcagttcatggtgttgaaggtttgttgttgaaaataccttcctgaggcacctcttcattgtgcttattcttcccacaacattgtgccaagacactgtcaagcctgggcctgtcaaagcctgggatgtcaaaggcctgggtctttctcatcctgctgtaatgtattgatagctgggggctctgcagaaggacaagggaaaggtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactaggggacaatggatatcatagagacagcaaaacttgaagaacatttggaaaatcaacccagtgatcctacgaacacttatgcaagacccgctgaacctgttgaagaagaaaacaaaaatggcaatggtaaacccaagagcttatccagtgggctgcgaaaaggcaccaaaaagtacccggactatatccaaattgctatgcccactgaatcaaggaacaaatttccactagagtggtggaaaacgggcattgccttcatatatgcagttttcaacctcgtcttgacaaccgtcatgatcacagttgtacatgagagggtccctcccaaggagcttagccctccactcccagacaagttttttgattacattgatagggtgaaatgggcattttctgtatcagaaataaatgggattatattagttggattatggatcacccagtggctgtttctgagatacaagtcaatagtgggacgcagattctgttttattattggaactttatacctgtatcgctgcattacaatgtatgttactactctacctgtgcctggaatgcatttccagtgtgctccaaagctcaatggagactctcaggcaaaagttcaacggattctacgattgatttctggtggtggattgtccataactggatcacatatcttatgtggagacttcctcttcagcggtcacacggttacgctgacactgacttatttgttcatcaaagaatattcgcctcgtcacttctggtggtatcatttaatctgctggctgctgagtgctgccgggatcatctgcattcttgtagcacacgaacactacactatcgatgtgatcattgcttattatatcacaacacgactgttttggtggtaccattcaatggccaatgaaaagaacttgaaggtctcttcacagactaatttcttatctcgagcatggtggttccccatcttttatttttttgagaaaaatgtacaaggctcaattccttgctgcttctcctggccgctgtcttggcctcctggctgcttcaaatcatcatgcaaaaagtattcacgggttcagaagattggtgaagacaatgagaaatcgacctgaggagcaaaacaaaggcatcagctcttacaccaaaagagttaacgctgtaaccaaaggtatagttttgttttttattttaggagaactgactggtaaatgaagaaatggaccaaattttgtgtaaacgattagaaagatgaacaaagtattgccctttgactggttttcttcttcatcctgagaaagatacattctcttgcagctcttcattcattggtgacaagcccccaccccgggactttactaatgagcttgttaaagaggtgccaaagaacatattcctcctttctttattctttctccaccaaaaccctctacttcagaattttttcaggatatttttcagcccaaggtcagaagaatgtgttaatattttaaataaaatatctggacatctaca

SEQ ID NO: 185892 - DNA, 567 bp, Homo sapiens
  Payload ID: 16600
  Gene Symbol: SGMS2
  Gene Name: sphingomyelin synthase 2
  ENST ID: ENST00000503862
  CDS Start-End: 193-567
gcaagtgccttcagctgggagtgtctggagccctggccaccagcggagctgcatcctgtggccctataacactcttctccaaaaggacctgccagagactgggagtgttgactgctgcaaggaccaaggtcaatagtgggacgcagattctgttttattattggaactttatacctgtatcgctgcattacaatgtatgttactactctacctgtgcctggaatgcatttccagtgtgctccaaagctcaatggagactctcaggcaaaagttcaacggattctacgattgatttctggtggtggattgtccataactggatcacatatcttatgtggagacttcctcttcagcggtcacacggttacgctgacactgacttatttgttcatcaaagaatattcgcctcgtcacttctggtggtatcatttaatctgctggctgctgagtgctgccgggatcatctgcattcttgtagcacacgaacactacactatcgatgtgatcattgcttattatatcacaacacgactgttttggtggtaccattcaatggccaatgaaaag

SEQ ID NO: 185893 - DNA, 570 bp, Homo sapiens
  Payload ID: 16600
  Gene Symbol: SGMS2
  Gene Name: sphingomyelin synthase 2
  ENST ID: ENST00000506993
  CDS Start-End: 467-570
atctgtacatccactgtgaaatggagtttcaaaatcacaagcttctttcccacatgaacataagactaggagcacatatggaagagtaaagttgaagggaatttggatgatgatttggcaagatgctgtaagtggattaggcaaggctgctaaagagagacaggaaatggctgtgttagtgcttcggacctccgttagaagtagcagttcatggtgttgaaggtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactaggggacaatggatatcatagagacagcaaaacttgaagaacatttggaaaatcaacccagtgatcctacgaacacttatgcaagacccgctgaacctgttgaagaagaaaa

SEQ ID NO: 185894 - DNA, 581 bp, Homo sapiens
  Payload ID: 16600
  Gene Symbol: SGMS2
  Gene Name: sphingomyelin synthase 2
  ENST ID: ENST00000503385
  CDS Start-End: 448-581
gagcagtgtatccagggagaggactaattacgaggtttgaaaacctcatcaggtggctggtttctgtagcaggactaaaagactgctctcctaaattgagaacagctggggctgtgtgctagcaagtataaaagaggtggcagtggtgccccgtgtccgaaagaagtgtgtgctctctggagcctgtggagctgaagccaaaggtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactaggggacaatggatatcatagagacagcaaaacttgaagaacatttggaaaatcaacccagtgatcctacgaacacttatgcaagacccgctgaacctgttgaagaagaaaacaaaaatggcaatggtaaacccaagagctt

SEQ ID NO: 185895 - DNA, 2138 bp, Homo sapiens
  Payload ID: 16601
  Gene Symbol: SPHK1
  Gene Name: sphingosine kinase 1
  Uniprot ID: Q9NYA1
  ENST ID: ENST00000323374
  CDS Start-End: 457-1869
gaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtagggccgcccaccctgccttcgcgccgctcgtggctcctgtgcggcccgccctcgcggggccccgggaactgggccacttgtcgcttgggcgagagcaggcggcagctggtggcccggttcgggcttggctttggcgcgacccgggagcggctcccacgagcgccgcgcgcgtcgcaacggagcggggccctgagaagcgcgcgccgcggctcccaccgctctggagctccgggcaggggacacggcaacctggatggctggggcagggatcctctcccagaacttcgtgcccagcaatgtccgctcaagttctgggatttttacgcagctggactcccctccccctggcagccccgaggggtccagccgccgcagggaatgacgccggtgctcctgcagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattccca

SEQ ID NO: 185896 - DNA, 1779 bp, Homo sapiens
  Payload ID: 16601
  Gene Symbol: SPHK1
  Gene Name: sphingosine kinase 1
  Uniprot ID: Q9NYA1
  ENST ID: ENST00000392496
  CDS Start-End: 354-1508
agtcacacggcgggggcgccctcggaggcaccggacctcagctctctggacttcccgggaacctggctccccgcgcgtggtcccgggatttagtcgggcgctccccacctctggcagctgcggccccggactccgccagcgctgtcttctctccctcaggtccagccgccgcagggaatgacgccggtgctcctgcagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcccagc

SEQ ID NO: 185897 - DNA, 2238 bp, Homo sapiens
  Payload ID: 16601
  Gene Symbol: SPHK1
  Gene Name: sphingosine kinase 1
  Uniprot ID: Q9NYA1
  ENST ID: ENST00000545180
  CDS Start-End: 810-1964
aatgcagctctgccttcctgctccctgtgcagaggtgccggctcctgcttcctggttcccagctttccttttgggaactgcctgaggtggtttgacacacagctgttgggcttctcttcccttgaggtctctgaaccagggcacccatgcagggagagggccctctgaaggtgaaggcagagacggggacgacgcagcagcaagacacggatgaccaaaggctgtcggcaaaccaccaggacacaggcctgggacagagtcacagcctcagaaggaaccaaccctgccaacaccgtgatcgtagacttcccaacctccaaaactgtgagacagtcaatttctgttgtctacgccaccaggacactaatacaaatgcctatagatgctgggcaggcagctgagacaaatggagtgggtagggctgcagctcgccaccttgagagggctctgaagagaatcaccctgaattgcagccacagtcagcagcctggagatggagtttcgccctgtcacccaggctggagtgcaatgggacgatctcagctcaccacaacctctgcctcctgggtgcaagcaattctcctgcctcagcctcccaagtagctgggactacaggtccagccgccgcagggaatgacgccggtgctcctgcagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcccagcctg

SEQ ID NO: 185898 - DNA, 588 bp, Homo sapiens
  Payload ID: 16601
  Gene Symbol: SPHK1
  Gene Name: sphingosine kinase 1
  ENST ID: ENST00000590379
  CDS Start-End: 254-588
gagcccccggcctgtcgcctgctctacccgggacagcgcgctaggcggcctcaggctcggtccagccgccgcagggaatgacgccggtgctcctgcagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctc

SEQ ID NO: 185899 - DNA, 1821 bp, Homo sapiens
  Payload ID: 16601
  Gene Symbol: SPHK1
  Gene Name: sphingosine kinase 1
  Uniprot ID: Q9NYA1
  ENST ID: ENST00000592299
  CDS Start-End: 393-1547
agtgccctccccgctccgcggcgccggctgcgaagttgagcgaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtccagccgccgcagggaatgacgccggtgctcctgcagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcccagcctg

SEQ ID NO: 185900 - DNA, 858 bp, Homo sapiens
  Payload ID: 16601
  Gene Symbol: SPHK1
  Gene Name: sphingosine kinase 1
  ENST ID: ENST00000588682
  CDS Start-End: 403-858
aagtgctaggattacaggagtgagccactgcgcccggcctgctgcttcctcctcctcagggagacgccacagctctgcggcaagcaatccaccaggcaccagatccccagatacctgcccttcagggagaaatagcctgggatacagagaggcccagaggggagctctggctggacttggcttctcagcgtggggtctgggttcacaggtccagccgccgcagggaatgacgccggtgctcctgcagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctg

SEQ ID NO: 185901 - DNA, 541 bp, Homo sapiens
  Payload ID: 16601
  Gene Symbol: SPHK1
  Gene Name: sphingosine kinase 1
  ENST ID: ENST00000591651
  CDS Start-End: 525-541
aaaacaaaaagcccctggaaaactgtgcacacacccatcccctcagcctgatgctccagcttggctgctaggagatcaatgcagctctgccttcctgctccctgtgcagaggtgccggctcctgcttcctggttcccagctttccttttgggaactgcctgaggtggtttgacacacagctgttgggcttctcttcccttgaggtctctgaaccagggcacccatgcaggggcttctgctggataaaccaaccaccacaaagtctacagaaacatgtctccaccccagcctcactccacaaatgcttctttggtggaaggctggttcctggtccagccgccgcagggaatgacgccggtgctcctgcagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagcgggcgg

SEQ ID NO: 185902 - DNA, 1851 bp, Homo sapiens
  Payload ID: 16601
  Gene Symbol: SPHK1
  Gene Name: sphingosine kinase 1
  Uniprot ID: Q9NYA1
  ENST ID: ENST00000590959
  CDS Start-End: 381-1577
gctccgcggcgccggctgcgaagttgagcgaaaagtttgaggccggagggagcgaggccggggagtccgctccagcggggcgctccagtccctcagacgtgggctgagcttgggacgagctgcgttccgccccaggccactgtagggaacggcggtggcgcctccccagcaaaccggaccgactgggtccagccgccgcagggaatgacgccggtgctcctgcagccacggctccgggcggggaaggcgagccccacagccggccctgcgacgcccgcctgggcagcaccgataaggagctgaaggcaggagccgccgccacgggcagcgcccccacagcgccagggaccccctggcagcgggagccgcgggtcgaggttatggatccagtggtcggttgcggacgtggcctctttggttttgttttctcagcgggcggcccccggggcgtgctcccgcggccctgccgcgtgctggtgctgctgaacccgcgcggcggcaagggcaaggccttgcagctcttccggagtcacgtgcagccccttttggctgaggctgaaatctccttcacgctgatgctcactgagcggcggaaccacgcgcgggagctggtgcggtcggaggagctgggccgctgggacgctctggtggtcatgtctggagacgggctgatgcacgaggtggtgaacgggctcatggagcggcctgactgggagaccgccatccagaagcccctgtgtagcctcccagcaggctctggcaacgcgctggcagcttccttgaaccattatgctggctatgagcaggtcaccaatgaagacctcctgaccaactgcacgctattgctgtgccgccggctgctgtcacccatgaacctgctgtctctgcacacggcttcggggctgcgcctcttctctgtgctcagcctggcctggggcttcattgctgatgtggacctagagagtgagaagtatcggcgtctgggggagatgcgcttcactctgggcaccttcctgcgtctggcagccctgcgcacctaccgcggccgactggcctacctccctgtaggaagagtgggttccaagacacctgcctcccccgttgtggtccagcagggcccggtagatgcacaccttgtgccactggaggagccagtgccctctcactggacagtggtgcccgacgaggactttgtgctagtcctggcactgctgcactcgcacctgggcagtgagatgtttgctgcacccatgggccgctgtgcagctggcgtcatgcatctgttctacgtgcgggcgggagtgtctcgtgccatgctgctgcgcctcttcctggccatggagaagggcaggcatatggagtatgaatgcccctacttggtatatgtgcccgtggtcgccttccgcttggagcccaaggatgggaaaggtgtgtttgcagtggatggggaattgatggttagcgaggccgtgcagggccaggtgcacccaaactacttctggatggtcagcggttgcgtggagcccccgcccagctggaagccccagcagatgccaccgccagaagagcccttatgacccctgggccgcgctgtgccttagtgtctacttgcaggacccttcctccttccctagggctgcagggcctgtccacagctcctgtgggggtggaggagactcctctggagaagggtgagaaggtggaggctatgctttggggggacaggccagaatgaagtcctgggtcaggagcccagctggctgggcccagctgcctatgtaaggccttctagtttgttctgagacccccaccccacgaaccaaatccaaataaagtgacattcccagcctg

SEQ ID NO: 185903 - DNA, 2963 bp, Homo sapiens
  Payload ID: 16602
  Gene Symbol: SPHK2
  Gene Name: sphingosine kinase 2
  Uniprot ID: Q9NRA0
  ENST ID: ENST00000245222
  CDS Start-End: 367-2331
cgactgactagccgggcgataacggcagagagcatagagcgcaggaacaagcgcaacgtccaagagggaagggccagcacgtcgggggcctctctggccctacccaggccgtgttctcgatagctttccggaagaaagggatctgggagcgagatgcgtgtagctagcacgatgcgtcgcgcggtgacgctctggcccgacgccgacggcctctcagtggctcccggaggacccggcgggcccagtgttggagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctca

SEQ ID NO: 185904 - DNA, 2492 bp, Homo sapiens
  Payload ID: 16602
  Gene Symbol: SPHK2
  Gene Name: sphingosine kinase 2
  ENST ID: ENST00000340932
  CDS Start-End: 513-1859
cgactgactagccgggcgataacggcagagagcatagagcgcaggaacaagcgcaacgtccaagagggaagggccagcacgtcgggggcctctctggccctacccaggccgtgttctcgatagctttccggaagaaagggatctgggagcgagatgcgtgtagctagcacgatgcgtcgcgcggtgacgctctggcccgacgccgacggcctctcagtggctcccggaggacccggcgggcccagtgttggagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctcag

SEQ ID NO: 185905 - DNA, 1493 bp, Homo sapiens
  Payload ID: 16602
  Gene Symbol: SPHK2
  Gene Name: sphingosine kinase 2
  ENST ID: ENST00000426514
  CDS Start-End: 1-150
atgaatggacaccttgaagcagaggagcagcaggaccagagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctga

SEQ ID NO: 185906 - DNA, 2866 bp, Homo sapiens
  Payload ID: 16602
  Gene Symbol: SPHK2
  Gene Name: sphingosine kinase 2
  Uniprot ID: Q9NRA0
  ENST ID: ENST00000598088
  CDS Start-End: 270-2234
agtgttggaggtgaggaggcggggctggcagggctagtcggggcatctggaaatttccgaccccacgcttcgggcgtttccttatcaggttcaccgctccctgatctcgcgctgcacttcgtaggcgcagccgctgcttgggaagtcctacttaagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctca

SEQ ID NO: 185907 - DNA, 565 bp, Homo sapiens
  Payload ID: 16602
  Gene Symbol: SPHK2
  Gene Name: sphingosine kinase 2
  ENST ID: ENST00000601704
  CDS Start-End: 167-565
gagcggatgcacaccctccccccacccctaggtctgatgggggctgttggtgctgacttgcgggaccgcctggaggaggacccggcgtgtgaggaggaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggat

SEQ ID NO: 185908 - DNA, 2136 bp, Homo sapiens
  Payload ID: 16602
  Gene Symbol: SPHK2
  Gene Name: sphingosine kinase 2
  Uniprot ID: Q9NRA0
  ENST ID: ENST00000600537
  CDS Start-End: 206-1993
agctagcacgatgcgtcgcgcggtgacgctctggcccgacgccgacggcctctcagtggctcccggaggacccggcgggcccagtgttggagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatggga

SEQ ID NO: 185909 - DNA, 713 bp, Homo sapiens
  Payload ID: 16602
  Gene Symbol: SPHK2
  Gene Name: sphingosine kinase 2
  ENST ID: ENST00000593308
  CDS Start-End: 498-713
cgtgtgaggagggtgcgggggtcggggcagggaccggagtctaggggactgagggaccaagaggaacagagactcaggcccgggactggggcaccggggtgggagatggaaatggaaaacctgggccaggactgaacccagccaggcctgggactgggttctggaaataagagtgcggatggcggtttgggggcccagggccagacacgcaggcctatggattggggaccaatggatggagacccaggtccaggtctcggggacccagggacagagacccaggcccaagactggaggacatctagggctctgtgcttgaacctgatttgaggttcccataatggggccagggcaggtttgggggtgaagcagacgtcctggacccgagagagccgctggggataggggggcagatgtagttcctaaggaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccc

SEQ ID NO: 185910 - DNA, 1542 bp, Homo sapiens
  Payload ID: 16602
  Gene Symbol: SPHK2
  Gene Name: sphingosine kinase 2
  ENST ID: ENST00000597434
  CDS Start-End: 495-1542
atctctgggcctttgttacgcgtgttagagtctctgtctttgcagctaaagacctcctccctcacgccccttttcttttgtgaattcaatggatgagacaggcccactctcccttaacaaagatggcgacaacggcgctgtctatggggccgcgacgtcgtctccgctgcgcgtcggccctcacccacgatggcggccagtctcccgaagcgcgaggccccgcccagctctcggcctctcccgcggccggtccctgcaccaagctcgcgagctgactggctccaccccccgcgccctcgtattggtgcggcccaggccggctgcacggccattggctgagcggatgcacaccctccccccacccctaggtctgatgggggctgttggtgctgacttgcgggaccgcctggaggaggacccggcgtaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggcccgcgggaggactcagactccagcacttccagcagcgcctgccctctatggacgacagcccggagctgcccacgggctgcagccagtatgccagggagctgccctcttcttccacaacagctggctctggggttctcaagatttattcaggatcgtgttaacggaggcggtgggaggatagggtccctgacgtgccggggacacacacagagaaccctccccgcccccgcaagggaggggggaggctcgctttttcttaaaaatataaatgtatttatctgca

SEQ ID NO: 185911 - DNA, 1394 bp, Homo sapiens
  Payload ID: 16602
  Gene Symbol: SPHK2
  Gene Name: sphingosine kinase 2
  ENST ID: ENST00000601712
  CDS Start-End: 257-1024
gtagctagcacgatgcgtcgcgcggtgacgctctggcccgacgccgacggcctctcagtggctcccggaggacccggcgggcccagtgttggagagctgaaggtcaggccaggacagtgagacctgactccttgctcctaccagcctactatggcttaagacccagggccagggtcccgttgatgtaacagagcagaggaccagcagatgaatggacaccttgaagcagaggagcagcaggaccagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacggggggtaggttgaggataccacgaagggagggatgagcccctcctggggtgatagggacccctatatctcccactcagccaaacccacagtcagtcaagtaaatcagcctgcctgtgggatgctcacccccagctcctggacatttttgcctgcctgcttcccagctgtatcccgagcgcccagaactctgcctggcatgggaggcactcagtgaattgtagggagcaaatgaaagatgaccaggaacctggccccgtaaggagtcgcctggaggtggccccacggctgtggtgggcctgggccatggccttcgtggtctcattgccagctgctttcctacctgtctctttccccaacccctgtttgctccttccttc

SEQ ID NO: 185912 - DNA, 2683 bp, Homo sapiens
  Payload ID: 16602
  Gene Symbol: SPHK2
  Gene Name: sphingosine kinase 2
  Uniprot ID: Q9NRA0
  ENST ID: ENST00000599748
  CDS Start-End: 195-2051
ggggaacaaaggtgagcgaaaggaggaggcagaatccgggcagagggcagggagagggcctgtggggaagggacctcagtcctgctcccacccgctccctggagagcaggcggccagacacccagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcggtacactgctcactgggcctcctggctgcccggggcgggagccctgaaactaaacaagcttggtacccgccgggggcggggcctacattccaatggggcggagcctgagctagggggtgtggcctggctgctagagttgtggtggcaggggccctggccccgtctcaggattgcgctcgctttcatgggaccagacgtgatgctggaaggtgggcgtcgtcacggttaaagagaaatgggctcgtcccgagggtagtgcctgatcaatgagggcggggcctggcgtctgatctggggccgcccttacggggcagggctcagtcctgacgcttgccacctgctcctacccggccaggatggctgagggcggagtctattttacgcgtcgcccaatgacaggacctggaatgtactggctggggtaggcctcagtgagtcggccggtcagggcccgcagcctcgccccatccactccggtgcctccatttagctggccaatcagcccaggaggggcaggttccccggggccggcgctaggatttgcactaatgttcctctccccgcgggtgggggcggggaaattcatatcccctgttcgtctcatgcgcgtcctccgtccccaatctaaaaagcaattgaaaaggtctatgcaataaaggcagtcgcttcattcctctca

SEQ ID NO: 185913 - DNA, 3085 bp, Homo sapiens
  Payload ID: 16602
  Gene Symbol: SPHK2
  Gene Name: sphingosine kinase 2
  ENST ID: ENST00000599029
  CDS Start-End: 992-2983
gaaaggaggaggcagaatccgggcagagggcagggagagggcctgtggggaagggacctcagtcctgctcccacccgctccctggagagcaggcggccagacacccaggtcagtgctcagggaccagctcttggcccctgccccttgcaggcgctcgcatgtggctcctctcggaccccgtagtccctgtcatatcccttctctccagctgtctccatgcctgcctcgtacccctcctatttgctctcccttccactctgtcttgcctttctcgttggggtgaaaaagtcttactctcttaagtatctttcatcgcctgagtttcacctcattgaccctgtttgtctcctctcagtgtttctctggctctcagaccctatctctattgcgtttgtgattgttttgctgttttacccactgcaccgtatggggggtgggggtgtcggggaggtgtgtctttcagtctttgcatgtctgtttctgcatatccaatcccactatccattccccttcctgtgccttcttttcccccaaagcccgttatcatcacccaaccacctgtatatttcaatcctttctcttgtttatctattcctatgaaggcaaggatttggggctattttgtctcctgctgtgtttgctaggcctagcaccgtgattggcacataaagggtactgaatacttactggggaataaatgattggatgtttgcatgcccgggtctccggccccctctgggatgctggcctctgtcccgcatcctcaaggtctgcccacacctgtctgagcctgtctgtctctgatgctcctgtctcacctgccactgcccctcattgtctcctcctgtccacagcccctgcccctccctgcccctgccatggggtcctgaattctcaccccttctctcctcccttcccacagaggccagaccaggagctgaccgggagctggggccacgggcctaggagcaccctggtcagggctaaggccatggccccgcccccaccgccactggctgccagcaccccgctcctccatggcgagtttggctcctacccagcccgaggcccacgctttgccctcacccttacatcgcaggccctgcacatacagcggctgcgccccaaacctgaagccaggccccggggtggcctggtcccgttggccgaggtctcaggctgctgcaccctgcgaagccgcagcccctcagactcagcggcctacttctgcatctacacctaccctcggggccggcgcggggcccggcgcagagccactcgcaccttccgggcagatggggccgccacctacgaagagaaccgtgccgaggcccagcgctgggccactgccctcacctgtctgctccgaggactgccactgcccggggatggggagatcacccctgacctgctacctcggccgccccggttgcttctattggtcaatccctttgggggtcggggcctggcctggcagtggtgtaagaaccacgtgcttcccatgatctctgaagctgggctgtccttcaacctcatccagacagaacgacagaaccacgcccgggagctggtccaggggctgagcctgagtgagtgggatggcatcgtcacggtctcgggagacgggctgctccatgaggtgctgaacgggctcctagatcgccctgactgggaggaagctgtgaagatgcctgtgggcatcctcccctgcggctcgggcaacgcgctggccggagcagtgaaccagcacgggggatttgagccagccctgggcctcgacctgttgctcaactgctcactgttgctgtgccggggtggtggccacccactggacctgctctccgtgacgctggcctcgggctcccgctgtttctccttcctgtctgtggcctggggcttcgtgtcagatgtggatatccagagcgagcgcttcagggccttgggcagtgcccgcttcacactgggcacggtgctgggcctcgccacactgcacacctaccgcggacgcctctcctacctccccgccactgtggaacctgcctcgcccacccctgcccatagcctgcctcgtgccaagtcggagctgaccctaaccccagacccagccccgcccatggcccactcacccctgcatcgttctgtgtctgacctgcctcttcccctgccccagcctgccctggcctctcctggctcgccagaacccctgcccatcctgtccctcaacggtgggggcccagagctggctggggactggggtggggctggggatgctccgctgtccccggacccactgctgtcttcacctcctggctctcccaaggcagctctacactcacccgtctccgaaggggcccccgtaattcccccatcctctgggctcccacttcccacccctgatgcccgggtaggggcctccacctgcggcccgcccgaccacctgctgcctccgctgggcaccccgctgcccccagactgggtgacgctggagggggactttgtgctcatgttggccatctcgcccagccacctaggcgctgacctggtggcagctccgcatgcgcgcttcgacgacggcctggtgcacctgtgctgggtgcgtagcggcatctcgcgggctgcgctgctgcgccttttcttggccatggagcgtggtagccacttcagcctgggctgtccgcagctgggctacgccgcggcccgtgccttccgcctagagccgctcacaccacgcggcgtgctcacagtggacggggagcaggtggagtatgggccgctacaggcacagatgcaccctggcatcgcccgcgggaggactcagactccagcacttccagcagcgcctgccctctatggacgacagcccggagctgcccacgggctgcagccagtatgccagggagctgccctcttcttccacaacagctggctctggggttctcaagatttattcaggatcgtgttaacggaggcggtgggaggatagggtccctgacgtgccggggacacacacagagaaccctccccgcccccgcaagggaggggggaggctcgctttttcttaaaaatataaatgtatttatctgca

SEQ ID NO: 185914 - DNA, 658 bp, Homo sapiens
  Payload ID: 16603
  Gene Symbol: SGPL1
  Gene Name: sphingosine-1-phosphate lyase 1
  ENST ID: ENST00000299297
  CDS Start-End: 1-609
attttggaagtatactccacaaaagccaagaattatgtaaatggacattgcaccaagtatgagccctggcagctaattgcatggagtgtcgtgtggaccctgctgatagtctggggatatgagtttgtcttccagccagagagtttatggtcaaggtttaaaaagaaatgttttaagctcaccaggaagatgcccattattggtcgtaagattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatggacgccttctggcaagaggggagagcctctggaacagtgtacagtggggaggagaagctcactgagctccttgtgaaggcttatggagattttgcatggagtaaccccctgcatccagatatcttcccaggactacgcaagatagaggcagaaatcgtgaggatagcttgttccctgttcaatgggggaccagattcgtgtggatgtgaagcattgtttttgttttgtttttctaatatgttggcgccatgaaaatcatcatgttcaaatattagtagtaataaaggtgatatgcctggca

SEQ ID NO: 185915 - DNA, 5745 bp, Homo sapiens
  Payload ID: 16603
  Gene Symbol: SGPL1
  Gene Name: sphingosine-1-phosphate lyase 1
  Uniprot ID: O95470
  ENST ID: ENST00000373202
  CDS Start-End: 201-1907
gcggctgccgggcctccaatctcggcggcggcggcggcaacaggggagcctgggtctcgcggcctgcgagtccgtcgcgtgctgagggagacgcaggaggtggagccggccgggtgctcgagggaaggagactggaagctggttccggcgtgaggagagtctgaaaaaggggagcgcggagaggaggctggaagaggaagatgcctagcacagaccttctgatgttgaaggcctttgagccctacttagagattttggaagtatactccacaaaagccaagaattatgtaaatggacattgcaccaagtatgagccctggcagctaattgcatggagtgtcgtgtggaccctgctgatagtctggggatatgagtttgtcttccagccagagagtttatggtcaaggtttaaaaagaaatgttttaagctcaccaggaagatgcccattattggtcgtaagattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatggacgccttctggcaagaggggagagcctctggaacagtgtacagtggggaggagaagctcactgagctccttgtgaaggcttatggagattttgcatggagtaaccccctgcatccagatatcttcccaggactacgcaagatagaggcagaaatcgtgaggatagcttgttccctgttcaatgggggaccagattcgtgtggatgtgtgacttctgggggaacagaaagcatactgatggcctgcaaagcatatcgggatctggcctttgagaaggggatcaaaactccagaaattgtggctccccaaagtgcccatgctgcatttaacaaagcagccagttactttgggatgaagattgtgcgggtcccattgacgaagatgatggaggtggatgtgcgggcaatgagaagagctatctccaggaacactgccatgctcgtctgttctaccccacagtttcctcatggtgtaatagatcctgtccctgaagtggccaagctggctgtcaaatacaaaataccccttcatgtcgacgcttgtctgggaggcttcctcatcgtctttatggagaaagcaggatacccactggagcacccatttgatttccgggtgaaaggtgtaaccagcatttcagctgacacccataagtatggctatgccccaaaaggctcatcattggtgttgtatagtgacaagaagtacaggaactatcagttcttcgtcgatacagattggcagggtggcatctatgcttccccaaccatcgcaggctcacggcctggtggcattagcgcagcctgttgggctgccttgatgcacttcggtgagaacggctatgttgaagctaccaaacagatcatcaaaactgctcgcttcctcaagtcagaactggaaaatatcaaaggcatctttgtttttgggaatccccaattgtcagtcattgctctgggatcccgtgattttgacatctaccgactatcaaacctgatgactgctaaggggtggaacttgaaccagttgcagttcccacccagtattcatttctgcatcacattactacacgcccggaaacgagtagctatacaattcctaaaggacattcgagaatctgtcactcaaatcatgaagaatcctaaagcgaagaccacaggaatgggtgccatctatggcatggcccagacaactgttgacaggaatatggttgcagaattgtcctcagtcttcttggacagcttgtacagcaccgacactgtcacccagggcagccagatgaatggttctccaaaaccccactgaacttggaccctttctagtctcaaggggattccagccttcagaaggttcttgggatatggaacaggccgtgcacaactttgacatctggtcttgctccatagagcacaactcaagatagaccatgagacagcttgagcctcaggattcttgttcttcctcttatcttccttttgtggtttttaatttgaagaccccagagaattccattacataatgattttgcccttgttataaatgttaccctaggaattgttttaaccatttccttttctaaactctctagctttcaactttacttaaacattgtgtggtagctctgacctgtcctgattctttagagaagctggggtacagtttatgagatagctagagcttctttgttatctcaggcaggaggcgtttacataacagatgtttcctcagctgggtgtgaggtatactctaagcaggaggctttttcagccttctctctcttttttttttttttttttttttttgagatggaattttgctcttttgcccagtctggagtgcagtggcatgatctcagctcactgcaacctccacccactgggttcaagcgattcttctgcctcagcctcccgagtagctgggattaccggcacccaccaccacgcctggctaatttttcaattttctttttcagtagagacgggttcaccgtgttggccaggctggtcttgaactcctgacctcaggtgatacccgcccccccgcctcagcctcccaaagtgctgggattacaggcgtgagccaccgtgcctggccctgtctctcttaagagtaggttcattgtctgtcttagagtcacttctattgcaactcattttctttttccagggcacagatcgaccaagctgccgttccctattctgcaggacaggactattctagcatacctgcttcgtccacccaggcagggtttggggtggtctcttctgtgcctgcagtccccatttgacacttggttgccaccatctttggagattattgtttggaatgatgcttccattggctttttcttgttaccatggactaggaagaaaacatggtttccaaataatctgggagcttttggccatggtgccgccttcctgaattggcagtggtcagagcacacctgaaccctatcctgggctggtgatgagcagaaatcagacctttttctatgcttttttgaatatcagagtaggatgaacacccagattcaaatatgtcaccaaagttggtggtggtccttccctgcacccttgcgttaagccattatgtaatgaaaatgtgtttgcttgaaggaacagctcaaagcaccttcacaagttgccttgacttaccctaggtgggtgtgaaagagcacccgtagcaaggaaaattttctctattagtgtgttcttctgcctcttcccccttgattcagctttcagaggtactatggcagttttgcctcaggtgctgaacatttctcagccctggctaaaagggagcagcacagggagagaaacaggataggaaagcagaatggcgagcagcctatggcccagggcctgtaatcccttcccaagactagctgctcagggtggtgcagggacaggaccagaccctgcgcctatttcctgccttctttcccctatagggaactctgtaggctgagccactgtcctgctcttatgacattatatcttgtgcctttctcctcagcagtgagcagtgagctactcctggcccaggccctaggggaaatggatcagtctttgaggtttctatttggggaggggagtacttaagatgagtcaaaagacactttcctctgttccattccccatctcagggactcctgaatattcagcctctccaggctggtgtcttctagtttcccccactgggaatgctggctgggagagccatgactaccagacttttcctcaggctccttggcatgttagtctgaattgttcttgagcactgtactactgacccaacaactgtgactagctggccacgccattcagggctggtgtggcatttatgtgtgtgtgtgtgtgtgtgtgtgtttttcctgtttgcccagcagtgcattgtgggttccaagagtgggtagtgtgtgtatgtgtgtgtgtcagagggagacctggcaggcacctctttgagagtagctgtggtcagagctgtttggtcagtgcattatgttgaatgaggtccaggaacccagagccacccagcagacaccactgtggcttgccagctgccaagatggagaagcatgtgcccctgtagagcgtctccccagaaccagaccccgagccactcgcttcctctgtgctgtgacaacattggtgccaggggagatggtgtttttcaaagggacctactgtagccactttaatttacaattaagagccttagtttgacttaacacttttgtaggcttttcattgtgtatttttgtgtatgtgtgcatatagcagctactctgtagcagaggtgggtagagacacttaatagtatcatgtcgcatgcagatgtcacatcggcctctgcaaaaactgtactgtcttgtttctgcattagacttaagtagtcatgtgaatatactgctatgtcacttttaatattacgagttttatacttggaaaatggtacttgcttcttttaaatctctgtcttctctaacctcccccttcccatttcaatgctcccttcctaatttcagcaataatctcaaaaagcaattaaatagttaaatgaccctaattgtaattactgtggatggttgcattcatttgattacttgggcacacacgagatgacaaatggggcagtggccatgcttgaatgggctcctggtgagagattgccccctggtggtgaaacaatcgtgtgtgcccactgataccaagaccaatgaaagagacacagttaagcagcaatccatctcatttccaggcacttcaataggtcgctgattggtccttgcaccagcagtggtagtcgtacctatttcagagaggtctgaaattcaggttcttagtttgccagggacaggccctatcttatatttttttccatcttcatcatccacttctgcttacagtttgctgcttacaataacttaatgatggattgagttatctgggtggtctctagccatctgggcagtgtggttctgtctaaccaaagggcattggcctcaaaccctgcatttggtttaggggctaacagagctcctcagataatcttcacacacatgtaactgctggagatcttattctattatgaataagaaacgagaagtttttccaaagtgttagtcaggatctgaaggctgtcattcagataacccagcttttccttttggcttttagcccattcagactttgccagagtcaagccaaggattgcttttttgctacagttttctgccaaatggcctagttcctgagtacctggaaaccagagagaaagaggatccaggatgtacttggatgaggaggcctggcttatctaggaagtcgtgtctggggtgcttattgctgctccatacagctgtacgtcagccccttggccttctctgtaggttcttggcagcaatgagcagctttcactcagtgacacaagtaattactgagtcctaatttgatagccaccaactgtacctgggtaggcaaagtcagatttttgagaacctttttcctgatttgaagttttaattaccttattttcttttatgctttcctctgtcttgtaatcttttctcttcttaatatccttccctataatttcaattatttggattaattttagaataaacctatttatttct

SEQ ID NO: 185916 - DNA, 462 bp, Homo sapiens
  Payload ID: 16603
  Gene Symbol: SGPL1
  Gene Name: sphingosine-1-phosphate lyase 1
  ENST ID: ENST00000409118
  CDS Start-End: 1-407
agattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatggacgccttctggcaagaggggagagcctctggaacagtgtacagtggggaggagaagctcactgagctccttgtgaaggcttatggagattttgcatggagtaaccccctgcatccagatatcttcccaggactacgcaagatagaggcagaaatcgtgaggatagcttgttccctgttcaatgggggaccagattcgtgtggatgtgtaagtatatgcaaggggcatccaatagccttattttttaggttaaaatagaagagtttttaataaatattaattatattttaaaaaataaaaaatattaaaaata

SEQ ID NO: 185917 - DNA, 3312 bp, Homo sapiens
  Payload ID: 16604
  Gene Symbol: SGPP1
  Gene Name: sphingosine-1-phosphate phosphatase 1
  Uniprot ID: Q9BX95
  ENST ID: ENST00000247225
  CDS Start-End: 96-1421
agcgctgtgccggttccgctgccgctggccaggagcgcggggacagttcggggctgcgccggaggccggcccgccttcccgggggttccgttatcatgtcgctgaggcagcgcctggcccagctggttggccgtctgcaggacccgcagaaagtggcccgtttccagcggctgtgcggggtggaagcgccgccgcgccgctcagcagaccggagggaggatgagaaagcggaggcgcctctcgccggagaccctcgactgcgagggcggcagccaggggcgcctggaggcccccagcctcccgggagcgaccgcaatcagtgcccggccaagccggacggcggcggcgcccccaacggcgtgcggaacgggctggcggccgagctgggcccggcctcgccgcggcgcgcgggcgctctgcgccgcaactcgctgacgggcgaggagggccagctggcccgcgtgagcaactggccgctctactgcctgttctgcttcggcacggagctgggcaacgaactcttctacatcctgttcttccccttctggatctggaacctggaccctctggtgggccggaggctcgtggtcatctgggtgctggtcatgtacctgggccagtgcaccaaggacatcatccgctggccgaggcccgcctcgccgcccgtggtcaagttggaggtcttctacaactctgagtacagcatgccctccacccatgccatgtccggcaccgccatccccatttctatggtcctcctcacctatggccgctggcagtaccctcttatatatggactgattcttattccctgctggtgttctctagtttgcctaagtagaatttacatgggaatgcactctattctggatattattgctggattcctatataccattttaatcttagctgtcttctatccatttgtggacctgattgacaacttcaaccaaactcacaaatatgctccattcatcatcatcgggcttcatttagctttggggatcttttctttcactcttgacacctggagcacatcccgaggagacacagccgagatactaggaagtggtgctggaattgcatgtggatctcatgttacttataacatgggtctagtattagatccttctctagatacattacctttagctgggccccccattactgtgactctgtttggaaaagccatattgcggatcctcatagggatggtatttgtactaataatcagagatgtaatgaaaaagatcaccattcctttagcctgcaaaatcttcaatataccgtgtgatgatattcgaaaagcaagacagcacatggaagttgaacttccttatcggtatattacctatggaatggttggtttctccatcacattttttgttccttacatatttttctttattggtatctcttgatggagaagtattgtttatgataagaaaggagggtatcagttactgatacccaaaaatatattccaggtaaagccaggtcagaattaggcttttgcaggaatttaacttaaataattatttaagtaaattcataagagtcagtgcattttatcattgcacatccagatactgttttaggtgagctgagctatttcgttactgagaaaatgataagtatccatttagaatgttcatgtaatgtttggagagttttgtattatggattcaacttatatataatatatataaggtacataatatgcaattatatatctgatatatattatatataaaataatatacctaagtgtttttttaaactatgggagtgtattataaaatcaataataatatgcaaacagttgtgcctgtgtatttgaactacatacaggtatgttgttattaacagatatatttaacatttatttactatgggagccatttcctaattgaattgcgtaattactagaccagaatgcatatgctactatacattgatttactgcctgtttttacactgccattacctttcatgttatccatgatgttgaacatgggaggcatttttaatggaccaaatttttagaaaaattagtttttggatttttttttaagttctgtatactgttttgaatgaactttatttgcagctattctggatgtcagtttaataattcaggtactgaattttattgcttgctaattgtgcctttccgttgctaaattaagaaatgctatgtgtactgtgatgtaaaaataagacattaactttatcttaagttacatataatcaagcaaatattttaaaaaatgtatgtcagggtgacaggcataaaagtaaattacccttaactctttagcctttatttagaaagaaatgtggaatgggctaaactttctcaccaatttattagaaagctaaatggataaatacttccctttttgtagatatttttctgtgcattgtaagttataggagcaggacatattttttgtacattgtcttgattgtttatactgcaggtaggtatttccagtgaatggaaacgttgaaatttatagatgggacaatgcacatacttcatatgtaaacaaagcatttttctaaataatttggaaaggattggatttagcaccgttaacttttaatacccatttattggctatttaaggtaaattataaaacctaaaattagtatcagtattttagatcctattattttttcaactttctattattttcacagtggaaaatttgcgtatagtattaaactattcttttttctgtctacctttatattttgaagtgtggttgtacttacgttaatagtaagtgtatttgtagaaagtttttcataaagaagagattaactttccatataaataaataccaggtatgaaattactgattttagtgcaatatctgtatgattatccagaactatcacttcagatgtttctattttgggcaccataactatttgagctcatatttttataattctgattgagaatttaggggcatggtaatttttaccaaaactgaagctggtaattttaagtaaagcaactaaatttaccctttacttattagttaaaaggaaaccaaggcatgtaggaaaatattggtacgttggaaaatgtgaaaagagctttactttcaaaatgtatgtttaatgaattgaattttagggaccgtttcccataatttgggcctatgctatcctgttgatttttatgtctagcttaaaaggtatttgaaaatgttccatttgtgttttattattttctgtcctatgacagttctatgctaaatgtattttaaaataaaagccaaattgaagattaaaga

SEQ ID NO: 185918 - DNA, 3336 bp, Homo sapiens
  Payload ID: 16605
  Gene Symbol: SGPP2
  Gene Name: sphingosine-1-phosphate phosphatase 2
  Uniprot ID: Q8IWX5
  ENST ID: ENST00000321276
  CDS Start-End: 87-1286
ggcgggggcgaggcgggagtggcggtgccagcggagggcaccggcccggcgtggcagcggcggcggagcgcggccccgggcacaccatggccgagctgctgcggagcctgcaggattcccagctcgtcgcccgcttccagcgccgctgcgggctcttccccgctccggatgaaggcccccgggagaacggcgcggaccccacggagcgcgcggcgcgggtccccggggtcgagcatctccccgcagccaacggcaagggcggcgaggctccggccaacgggctgcgcagagccgcggcgccggaggcttatgtacagaagtacgtcgtgaagaattatttctactattacctattccaattttcagctgctttgggccaagaagtgttctacatcacgtttcttccattcactcactggaatattgacccttatttatccagaagattgatcatcatatgggttttggtgatgtatattggccaagtggccaaggatgtcttgaagtggccccgtccctcctcccctccagttgtaaaactggaaaagagactgatcgctgaatatggaatgccatccacccacgccatggcggccactgccattgccttcaccctccttatctctactatggacagataccagtatccatttgtgttgggactggtgatggccgtggtgttttccaccttggtgtgtctcagcaggctctacactgggatgcatacggtcctggatgtgctgggtggcgtcctgatcaccgcactcctcatcgtcctcacctaccctgcctggaccttcatcgactgcctggactcggccagccccctcttccccgtgtgtgtcatagttgtgccattcttcctgtgttacaattaccctgtttctgattactacagcccaacccgggcggacaccaccaccattctggctgccggggctggagtgaccataggattctggatcaaccatttcttccagcttgtatccaagcccgctgaatctctccctgttattcagaacatcccaccactcaccacctacatgttagttttgggtctgaccaaatttgcagtgggaattgtgttgatcctcttggttcgtcagcttgtacaaaatctctcactgcaagtattatactcatggttcaaggtggtcaccaggaacaaggaggccaggcggagactggagattgaagtgccttacaagtttgttacctacacatctgttggcatctgcgctacaacctttgtgccgatgcttcacaggtttctgggattaccctgagtctcaaacagttggaaactagcccactggacatgaaagccaagacataggaaagttattggtaggcaaatcttgacaacttatttttctttaacaacaacaaaaagtcatacggctgtcttgctactaccagataaatgatgctgctgtgtgaaaggaagaactgtctcatagcggtcattggtcgtccgtggtggttggttgtgctacagttgaacccaggctaaagaccataatccggatctttaaaggcacacaccgcgccccccccccccccgcccggcccctgctcctctcgctgttgcacgggctttggatctagtcatgggctggcaggaattgtggcctggcttaggaatagctatgagccccactgggttctggagagccagtagagatggggtgatctgggaggctggaggtagagcctttcttttccgttacaaccttgcctagcatggagttatttctaaaatgggaactttggtctaggagaaggggtggcaccatatgaaacggcattccttggacagggtgacttccttatcgtttatttggtgattttttgttttgttttgtttgagacaggatcttgctctgtttcccaggctgtattacagtggcacaatctcagctcactgcaaactctgcctcccgggctcaagcaatcctcctgcctgagccaactgagtagctgggactgtaagcatagaccaccatgtgcccagctaatttttgtagagacagggtttctccatgttgcccaggtacgtctgaaactcctgggcttaagtgatccacccacctcagcctcccaaagtgctgggattataggcatgagccactgtgcccggcctcctccttgttatgatcaaattagactgtgcctggttgggtggtaagatcactctgaaagaaagctcactgtgaagagatgaaaggtggaggcagagctgtgaggtcatggggaaaagcctgctttccttataagtcctgctgttcatgttggaataaggatctgctcttccttgtttccatgcattttgcaggattccaggtaccattaccacactcttctgacccatgaaaccaactggctgctcacacatcaccaaacaggttgggggttagccttcagcacaggtggatacatctgggattcactgagattcctgccctctcctgcttcctagtggtttgggacaggccctctgcccatcgtcagcagttttttgctttcatacaaacctggaaggcactggcatctgcctaggaaagtggatctgtgaagaacagatgaactcaatcctttctggagtctgacaaagaagggataggcttccttgacattgcctgtcctgacaaggcctccctgacattactcctccaatttcacagttaccttctgtaaatctattttctcatctactgaatagaatcaggcgccctttttgtcttcccacctcttatctcttggcaattttaaggggaattaatgcaagaacaactttagtgtctcttgggaaaacaagccaaccaaatacaaaacccattaagcctactagggtgagtcctcttaacatgggaaggcgatgattatgcaaacaccggagttccctcctcttcagttcctaagaataaagaacaggtatcaagaactttctttaaagttagtgtaactatagttaacaaagtatccattgaagtttagtgcctgtaggactgagccagtgctttatcaacccaacacatcatcaccatgtgcatactctagaaaaaaaaatagcttccttaaaagttacagaggctcttaacgtgttaaaaccgaaaaatcacatttttcttgatttcaaatatgttctacggccttactgttgggatgatatttagtatgtaacttagcattccaatttctcaagaatttttaggccgggtgcggtggctcatgcctgtaatcccagcactttgggaggccgaggtgggcggaccacgaggtcaggagatcgagaccatcctggctaacacggtaccccgtctctactgaaaatac

SEQ ID NO: 185919 - DNA, 2909 bp, Homo sapiens
  Payload ID: 16606
  Gene Symbol: S1PR1
  Gene Name: sphingosine-1-phosphate receptor 1
  Uniprot ID: P21453
  ENST ID: ENST00000305352
  CDS Start-End: 376-1524
ggcgcggcgctgggtgacttcgcgtagcaggcagggaactggccgcggcgagcgggactggccattggagtgctccgctgcggagggaggggaccccgactcgagtaagtttgcgagagcactacgcagtcagtcgggggcagcagcaagatgcgaagcgagccgtacagatcccgggctctccgaacgcaacttcgccctgcttgagcgaggctgcggtttccgaggccctctccagccaaggaaaagctacacaaaaagcctggatcactcatcgaaccacccctgaagccagtgaaggctctctcgcctcgccctctagcgttcgtctggagtagcgccaccccggcttcctggggacacagggttggcaccatggggcccaccagcgtcccgctggtcaaggcccaccgcagctcggtctctgactacgtcaactatgatatcatcgtccggcattacaactacacgggaaagctgaatatcagcgcggacaaggagaacagcattaaactgacctcggtggtgttcattctcatctgctgctttatcatcctggagaacatctttgtcttgctgaccatttggaaaaccaagaaattccaccgacccatgtactattttattggcaatctggccctctcagacctgttggcaggagtagcctacacagctaacctgctcttgtctggggccaccacctacaagctcactcccgcccagtggtttctgcgggaagggagtatgtttgtggccctgtcagcctccgtgttcagtctcctcgccatcgccattgagcgctatatcacaatgctgaaaatgaaactccacaacgggagcaataacttccgcctcttcctgctaatcagcgcctgctgggtcatctccctcatcctgggtggcctgcctatcatgggctggaactgcatcagtgcgctgtccagctgctccaccgtgctgccgctctaccacaagcactatatcctcttctgcaccacggtcttcactctgcttctgctctccatcgtcattctgtactgcagaatctactccttggtcaggactcggagccgccgcctgacgttccgcaagaacatttccaaggccagccgcagctctgagaagtcgctggcgctgctcaagaccgtaattatcgtcctgagcgtcttcatcgcctgctgggcaccgctcttcatcctgctcctgctggatgtgggctgcaaggtgaagacctgtgacatcctcttcagagcggagtacttcctggtgttagctgtgctcaactccggcaccaaccccatcatttacactctgaccaacaaggagatgcgtcgggccttcatccggatcatgtcctgctgcaagtgcccgagcggagactctgctggcaaattcaagcgacccatcatcgccggcatggaattcagccgcagcaaatcggacaattcctcccacccccagaaagacgaaggggacaacccagagaccattatgtcttctggaaacgtcaactcttcttcctagaactggaagctgtccacccaccggaagcgctctttacttggtcgctggccaccccagtgtttggaaaaaaatctctgggcttcgactgctgccagggaggagctgctgcaagccagagggaggaagggggagaatacgaacagcctggtggtgtcgggtgttggtgggtagagttagttcctgtgaacaatgcactgggaagggtggagatcaggtcccggcctggaatatattttctacccccctggagctttgattttgcactgagccaaaggtctagcattgtcaagctcctaaagggttcatttggcccctcctcaaagactaatgtccccatgtgaaagcgtctctttgtctggagctttgaggagatgttttccttcactttagtttcaaacccaagtgagtgtgtgcacttctgcttctttagggatgccctgtacatcccacaccccaccctcccttcccttcatacccctcctcaacgttcttttactttatactttaactacctgagagttatcagagctggggttgtggaatgatcgatcatctatagcaaataggctatgttgagtacgtaggctgtgggaagatgaagatggtttggaggtgtaaaacaatgtccttcgctgaggccaaagtttccatgtaagcgggatccgttttttggaatttggttgaagtcactttgatttctttaaaaaacatcttttcaatgaaatgtgttaccatttcatatccattgaagccgaaatctgcataaggaagcccactttatctaaatgatattagccaggatccttggtgtcctaggagaaacagacaagcaaaacaaagtgaaaaccgaatggattaacttttgcaaaccaagggagatttcttagcaaatgagtctaacaaatatgacatctgtctttggcacttttgttgatgtttatttcagaatgttgtgtgattcatttcaagcaacaacatggttgtattttgttgtgttaaaagtacttttcttgatttttgaatgtatttgtttcagcagaagtcattttattggatttttctaacccgtgttaacaccattgaatgtgtatttcttaagaaaataccaccctcttgtgcccttaaaagcattactttaactggtagggaacgccagaaacttttcagtccagctattcattagatagtaattgaagatatgtataaatattacaaagaataaaaatatattactgtctctttagtatggttttcagtgcaattaaaccgagagatgtcttgtttttttaaaaagaatagtatttaataggtttctgacttttgtggatcattttgcacatagctttatcaacttttaaacattaataaactgatttttttaaaga

SEQ ID NO: 185920 - DNA, 3582 bp, Homo sapiens
  Payload ID: 16607
  Gene Symbol: S1PR2
  Gene Name: sphingosine-1-phosphate receptor 2
  Uniprot ID: O95136
  ENST ID: ENST00000590320
  CDS Start-End: 112-1173
cggccgccctggggacgcagacgccaaggcccctccggccagggccgggagccgggccggcctagccagttctgaaagccccatggccccagcaggcctctgagccccaccatgggcagcttgtactcggagtacctgaaccccaacaaggtccaggaacactataattataccaaggagacgctggaaacgcaggagacgacctcccgccaggtggcctcggccttcatcgtcatcctctgttgcgccattgtggtggaaaaccttctggtgctcattgcggtggcccgaaacagcaagttccactcggcaatgtacctgtttctgggcaacctggccgcctccgatctactggcaggcgtggccttcgtagccaataccttgctctctggctctgtcacgctgaggctgacgcctgtgcagtggtttgcccgggagggctctgccttcatcacgctctcggcctctgtcttcagcctcctggccatcgccattgagcgccacgtggccattgccaaggtcaagctgtatggcagcgacaagagctgccgcatgcttctgctcatcggggcctcgtggctcatctcgctggtcctcggtggcctgcccatccttggctggaactgcctgggccacctcgaggcctgctccactgtcctgcctctctacgccaagcattatgtgctgtgcgtggtgaccatcttctccatcatcctgttggccatcgtggccctgtacgtgcgcatctactgcgtggtccgctcaagccacgctgacatggccgccccgcagacgctagccctgctcaagacggtcaccatcgtgctaggcgtctttatcgtctgctggctgcccgccttcagcatcctccttctggactatgcctgtcccgtccactcctgcccgatcctctacaaagcccactactttttcgccgtctccaccctgaattccctgctcaaccccgtcatctacacgtggcgcagccgggacctgcggcgggaggtgcttcggccgctgcagtgctggaggccgggggtgggggtgcaaggacggaggcggggcgggaccccgggccaccacctcctgccactccgcagctccagctccctggagaggggcatgcacatgcccacgtcacccacgtttctggagggcaacacggtggtctgagggtgggggtggaccaacaaccaggccagggcagaggggttcatggagaggccactgggtgaccccagatagagacttggggctactgagccagatgcccccgccccacagacctgggtgatgttgcaaatatttcacacctggaaaggccagataaggcactgactagtcacatagcagtgttgcagtgcggtcctgagggccagtccagtggctagtgtgacccctttagaactggatcctggggaggccagggcaggggacctgtgaagagccagggtgagggcaggcagcatttaaggggagctcagggcaggagcactttaccacctggtacaaaggatttttttttttttttgagacggaatcttgcactgctgcccaggctggagtgcagtggcgtgatctcggctcaccgcaagctccgcctcctgggttcatgtcgttctcctgcctcagcctcccaagtagctgggactataggcgcctgccaccacacctggctaattttttgtacctttagtagagatggggtttcaccgtgttagccaggatggtcttgatctcctgacctcgtgatccgcccgcctcggcctcccaaagtgctgggattacaggcgtgagccaccgtgcccggctttttttttttttttttttttttttttttttttttttgagatgaagtctcgctctgttgcccaggctggagagtgcagtggtacggtctcagctcactgcaacctccacctcccaggttcaagcgattctccagcctgagcctcctgagtagctgggattacaggtgcctaccaccacgcccaggtaattttttttttttttgtatttttagtagagacggggtttcaccatgttggccaggctggtctcgaactcctgacctcatgatccgcccgtgttggcctcccaaagtgtgggattacaggcgtaagccacctcacctggcggtacaaagaatttctgcattttcttccctggcccctagtcctgcaccgatttctccttttcgaatgtattcctcctgccaccttctctgggcaacttcgtgcgactacagaaccactgtcctgaggagctagaggcctcctctctgaccatccagagcccaaatccacagcttccccaaatttcatcagctgccacttgacgacttctccccgtctctctgaggcccggaaaccacggctggaggtggggaggggatggcggctgaggtccattcctcattctcagacctcattgctcagttgcactatttggggcacagaataatcaccaaaagtgagaaaaacgagtttgggtggctggggaggactttgggactcttgatgcaaggcgcaacttgagaaaattctgggtgtgatatttgcacagacaccctcctttcaaaaacagccaccccccaagctattctcagctccacacctgcagccccagctaaggtaccaggtctcctgagcaaggcagagagaagccttgagccttctctgtgtcttctttcaagaaccccgctgtgtcttctttcaagattttttttttgagacagtttcaagatttttgttttgtttttgagatggagtctcactgtgtcacccaggctgaggtggcagtggttcaatctccgttcactgccacctccacctcccgggttcaagcgattctcctgcttcagcctctcgagtagctgggactacaggcacctgccaccatgtctggctaatttttgtatttttagtagagacagggtttcactacgttggccaggctggtctcaaactcctgacctcaagtgatccgcccgcctcggcctccccaattgctgggattacaggcgtgagccactgtgcccggccttcttctttcaagttatatagaatggagcatgggggtggcagtggctagggacatttcctggggacactctcccctaaccccccagaaggacttcacaaaaacctgtggataatggaagggatgttacggtacaaacgtatatttatgtgtgtgtgtgtgtatgtgtgtgcgcgcgcgcgtgtgcacataggcgtgatgtctgtgaccctcctctcctcgtcacatttcccccagaatgaatgctgtcctgtctgctcatgtttgtgttgaagctgccaaagtcggggagctctggtcctgcccagacccctttggaattgctggcccatcctcccactggagagctggggtgcagctcaccttggggaaggaaacctcatgcctcagagtaatttcttgtgaatgcaaagcctgggggagcgggtctttggggggcaaggagccagtcaggggcttgtttcccctcatagagctccccagacgtgcctccgcaatgcctgaaacccagacctaggctaataaacggttcaatttctg

SEQ ID NO: 185921 - DNA, 4206 bp, Homo sapiens
  Payload ID: 16608
  Gene Symbol: S1PR3
  Gene Name: sphingosine-1-phosphate receptor 3
  Uniprot ID: Q99500
  ENST ID: ENST00000358157
  CDS Start-End: 397-1533
tagtctctgactcgctcgggcagaggccgaggaagccggttccggggacgggcaacagggactcagggaccagaaggcggctgcaggacgcgaccgagcaggaccccaggcccgggaacgacgtcgcgagcgctgagactgccgggcctcccagcccatctggcattcgagcgcaggaccgggcgccccggcaccgccgcgcgccacccgctaggatgccggtggccccagcgccctcagccgacggaggagccctttttcaacgccctcgctggagtctggcctgcacgccttgctgaatgaagccggaacctcagccccgcttccctttgaaatgaatgttcctggggcgccctctcgtggattttggagctaatcgtctgtgaatgccaagtgatggcaactgccctcccgccgcgtctccagccggtgcgggggaacgagaccctgcgggagcattaccagtacgtggggaagttggcgggcaggctgaaggaggcctccgagggcagcacgctcaccaccgtgctcttcttggtcatctgcagcttcatcgtcttggagaacctgatggttttgattgccatctggaaaaacaataaatttcacaaccgcatgtactttttcattggcaacctggctctctgcgacctgctggccggcatcgcttacaaggtcaacattctgatgtctggcaagaagacgttcagcctgtctcccacggtctggttcctcagggagggcagtatgttcgtggcccttggggcgtccacctgcagcttactggccatcgccatcgagcggcacttgacaatgatcaaaatgaggccttacgacgccaacaagaggcaccgcgtcttcctcctgatcgggatgtgctggctcattgccttcacgctgggcgccctgcccattctgggctggaactgcctgcacaatctccctgactgctctaccatcctgcccctctactccaagaagtacattgccttctgcatcagcatcttcacggccatcctggtgaccatcgtgatcctctacgcacgcatctacttcctggtgaagtccagcagccgtaaggtggccaaccacaacaactcggagcggtccatggcactgctgcggaccgtggtgattgtggtgagcgtgttcatcgcctgctggtccccactcttcatcctcttcctcattgatgtggcctgcagggtgcaggcgtgccccatcctcttcaaggctcagtggttcatcgtgttggctgtgctcaactccgccatgaacccggtcatctacacgctggccagcaaggagatgcggcgggccttcttccgtctggtctgcaactgcctggtcaggggacggggggcccgcgcctcacccatccagcctgcgctcgacccaagcagaagtaaatcaagcagcagcaacaatagcagccactctccgaaggtcaaggaagacctgccccacacagccccctcatcctgcatcatggacaagaacgcagcacttcagaatgggatcttctgcaactgatcgtctccatgcgccctgctctgcggctgtgttcttatttattgcatgcgtcgcttccacaggggcccctcaagagctgtgactcgggagagctaccttactttgaccaacagcctgcccagtgtggatgtctcttacagagggggcccaaggaatcaccaccccgcttcagtgtaaacaacgtgccttgtccactttgggctccagagtctttcagatgtactaagctgctgacatcatccactgccttctgctgcatcctagacaccctccctgttgttcacagagagggaaggtcgtgggccacacaatgctgtgtgaccctctccgtgtgcctctgaatggtgttttgatgattttacactacatttcctgtgcgtagaatggatgcttgtatattcgtacatctctatgttacacagaatttgtgttgcaggtgtttgccatgtggtacctacatagaatctccatacaacacacaggtaacaggttatacaagtggattcagactgaacccccagtacaaggacattgttttgaactaggtggacatgccatccctggtctccttagactgacatgattctcatgttaaccaagttttaaaagttcaaattccccaaaaaggcttgtccaaggctggccccagatgtgtgggtctgacccacaccagccctgtgtcctgtcctttcagtcatttgtccctgcgtaattttaatcgtattccaaagcccaattatgtgatggttttcaggtttctgcaaattacagaagagccagccaagatcacccaggagcttgtgcccccagatgggccaaagaaagagcctatgaaggagaagcagaagcagacggctggcctggctcaccttcccacgccagtggggcaggggtctgcttcaggaaatggaagctgtccaggaaatgagcagagattcacaagacagcactttgattctatgttgagtttgtttctatattagaaaagcagcaagtcagtaatcccccgtggcatcacagctaagtagctgtggccaccggcagtttcacagcatcctgaaagctggcactgatcgtgactatcagtgaaagaagtttaattttcaggttagaaaatgtgatctggcagtttatgcattcttcagagtaatgtaataatacctatgtgatgctgtaattttacttttcaacataagttgaacccgtagcagtctgtttaccttgtaaagggattacttagaagacatttttgtacatgctcttccccaaggattgtacgtattatacaaatagatggaaagaaaagtgaacacgtttgtagaactttcataagcacacagttgctgtgttgagttctctttaaaaacaaggacaaaaccaaccagcgttcaaaggaacctcccatcagagtcccctaaagtattttaggttcagtgagcatttgcctgaataaaacctaaaagagtagtcttaacacattactaactttttctaagagaaattgattcctgttttgtcatctgatgcaatttgctcttataaagagacattttcataggttcagagtaactcacctccatgggctgaccaaaggcttttctaatttttgttactgatgagatgaaacctatttgtaaggagatcttccccaggagcatttctgttgccttcttgacatcaatgaaaagtagcatattctcttatgaaatagcatgagaaaacacagggcatttctaggacagtaaaacgttaaagtactggattaagaaaacaacaacaggctgggcgcagtggctcacacctgtaatcccagcactttgggaggctgaggcgggtggatcacctgaggtcaggagtttgtgaccagcctggccaacatagtgaaatcctgtttctactaaaaatacaaaaattagctggatgcgatagcacgtgcctgtagtcccagctactcgggaggctgaggctggagagttgctcaaacccgggaggcggagattgcagtgagccaagatcgcaccgctgcactccagcctgggtgacagagcgaccctctgtctcaaaaaataataataataataaataaaacaacaacaaaatgcatcagagagccaaaacattcagtattgcattttcacataggtgatgaaatgactttggaactttatctgtgttatagttatgagttgctttgggagacttggagctctctgtagctattgttcataacactttgctccataaccctgatgtccgcagtatctaagtatctcagccttcatccattaactctactagggagcccacagccaccatttccactaggaggtatcaatatttgtggtatgacataaggctcccttgaaataacaagacttttgagcaatctgaattaaaaatacatcaaaaaagtaatagcgctcatttgctaaatgcaaaaaataatcacctttgataccaatgtgcaccaatatgcctaactagctagccagctggagataatttaccagggaatgtttcaaagccctaaccttgaagtttggaaacaggtggtcttctatgctgcagagaaactatgcattaggtctcttttcaattagaaacctttactatttccaatgtatgtttgttaaaaataataataataaaaccaaaagcctttgtggaaaccca

SEQ ID NO: 185922 - DNA, 8505 bp, Homo sapiens
  Payload ID: 16608
  Gene Symbol: S1PR3
  Gene Name: sphingosine-1-phosphate receptor 3
  Uniprot ID: Q99500
  ENST ID: ENST00000375846
  CDS Start-End: 4696-5832
catggggagaggaaagcaatggacacaattgtatcctgtagggtttcattcacgtgaaggtcagaagcaggctaaactcacctaggggagagtcctatcccaggtagtggtcatgcttggggacaggtggtgactaggaggggcacaaggaaggctgcagggtccggcccatcttgttgctggcctgggtgctggtctcactgatctctgtgtggtggggcaggtcagcctcccaggcctgctggtgcctgcagtgcccagcactcctgccgtgcctggcagtgttagtaccaatccgccagagtgactgactcccctcttgccctgagtagggcttgctgactccaggagcctcagggcggggtgggctttgagctttcttctagcaaacttgaggtctgtggctggtacccctcaggagcggaggggaactcttgtccatgagatgcttttaaccgtgcgcaataatgtgtagacgcatccaaaatcaatctggcctttagcccagcacttaactcttgggatgaggcctgctttgtaaatgttgataatccagagaaaatgagcttttagattccaaagacagccagatatcttccacttatgcaaaatgcagagaatcatatttaacaaaagatgttctggacaaatatgcttcttgagggatgaatatttaattataagggaaatgataaatcaaacattaatgggaaaatatgtttgccctcaagattcatgattttgatgggtctctggcaaatcttatactatgtttattggggttattttattgctggttattagtttttaattgtttgcttgttttctgctctgatcaatttttgtataagccgtgggtctattcaccctcttctctccattcccgggagcaagtccacatctggctgttggatgcatggcaaaagcaaaggtgtggagaaggttcagaggagacaggacatgtataaaatggtagggtcaggttgtcatgggggaaactgaggcacaggaggcaagctgagttagtacaagaacagtctgaatcataacgacatgccagtattacctaaaaggatgaggaacatggagctgtacttgaatccctacgtgagctggggaaaaggggcctcaggaatcactgacattggaaccaaggtttgtctgcagcttgtcggtttctgggacagaaacccaacatactggagtgggtatcccagcaatctgtaggataaaccaggacactgtggtgtcatggatagctggctgtctgccaggtgatggcccctctggttgcaatgtgagccgggcaggtcatccatttggcagcatggtgagggctctggccccagttgctatgggagggaggatgctggcacagggcactgttcacagactgcctttgctccatgccttttccatgagcatgagtggctgttcgtgtgggaaacggcagagccctcgcggtccccatcagcactgtgcagtggtaccggaggtggcaggagacagcctgatggcccaggttgtcttcatacccggcttcatgccagggtgcatgccgggcatagcacatgtgtccctgagaggcccctgatcaggggtggaaacccagcaaagtgaaaatcagaaatagtgattctccagttcctgttcacagataaagaaagaaagaaataataagcaatactaggcctggtgtggtagttcacacctgtaatcccagcactttgggaggccaaggcaggcaatcacttgaggtcaggagttcaagaccagcctggccaacatggtgaaaccccgtctctactaaaaatacaaatattagccgggcatggtggcgggcgcctgtagtcccagctactcaggaggctgaggcagaagaatcgcttgaaccggggaggcggagggtgtggtgagccgggatcgcaccgctgcactccagcctgggtgacagaatgagactccatcccaaaaacaaaacaaaacaaaacaaaaaacaaacaaaaacaactaaaaggacagtatctttttagcacccatcagtgtacaggatgctggggagggtactgtgaacttacccatggtgaaagtccctgtgttaatggataagctcaatgctcagaaaatgctgctgactgtggtattgccccatttaaagagacagtttgcagtacgttttcagaagtggcatgcagcctcagagaaaagtcaccaggggctggcatgattccagaaaatgttacagagcaagtggaatttgacttgaggcttgaaggatgggcaagatttaaataaaattcagaaacggtagagagggaggggctggggggaaggctgcccactggactgtcctgtttgcctccaggagaacctacaggcaagacatggtctcttctcaggtgaatgggaagccaagtagggctggcatgggtgagccacagctcgaggaggcaggccccgggccctgcgctgcctgtcatggctcatgagtgatgggagagatctgggcaggcaacctcctctcatcctgcatcatcagcctggacttggaacttggctgctttttctttctgcagttagcagagggccttggccaacacataagcctttctgccagcacttggcattccagctgacctcgacccaaggcctctgtgacttcaggaggcggcagctgggaagggtcagggcagttccaggcagagcacagacgtcagctcagacatcctaccccccgccaaccccccgcccccggggtttccagagcaaccaacaccaccaagctccaggacactggaaaaaaaatctttgcaaagaagcaaggggccatctcagaaaatccaggtcccccaaattgatgtagggagaggagggctttgacagcattcagcactccagagggtcacgaggatacagaaaccatttggagccacctctgcttctcagccccacccaggcaagccctggatcttcaagggactgatttgtacctgggaataaactcatgcatggatgagattcagagtcaatcacaccctaaaatgcagagcccatagtattggtgagttgttcatgtgtctctgaagcaaatttagggctgtggttcaaacatcgtaaaagttaaaaaaaattcactggatacacacagtaggctcttttaaattagcctcatttgaacttaattacatatttaaatactcaaataataaatgatggctgggtgcggtgtctcatgcctgtaatcccagcactttgggaggctgaggcaggctgatcacttgaggtcaggagttcgagcccagcctggccaacatggtgaaaccccgtctctactaaaaatacaaaaattagccatgcatggtggcgggtgcctgtaatcccagctacttgggaggctgaggcagcagaagcacttgaacccaggaggcagtggttgcaatgagccgagatcgcaccactgcattccagcctgggtgacagagcaacactgtgtctcaaaagaaaattttttttaataaaaataaaaaataaaataaaataagtgagtccactgaaagcggtttctaccttgatagttgggtgtgtggcgtcatcaacatcacagaaggctgatcgatattaccaggtgtggttgagtgcaagtgtttgaggtctcgtgggggaagagtttggaattcagaatccattgaggccttcactcaccactttccctctctcgctgtgttcccaaatgtgccacttttctgttggctcacatgcacccatgctctatttgatattcagggctctgaatttcaagccagactcagtcagtgtgattgtcactgctttcctgtccttcctttatcatctgtagacttgggtcccgtttttgcaggttgatgttctgtcttcgctgggctctggactcactgctcacgagtgcggtgtctgcatgggcactgcccagacatgcactgttggtccctcgatggctgcatggtcaggcctcagggctctctgccaggccgacctacagcccatacagacctgatttctgggcctggatccaggggatgccatctgggaagtgcgggatcttcccacgatgtcactgtaaaactcaccagggaggttttagaaattgaaccggcatcattcagattccatcctgctttttggtcctgagaaaatcctgcttttccctgagtaactgggataatgggtcaccagctcccatgccctagatgaggactagttagcattttctagtgcctggagatttccagatggaagctgtacttgggtctgtgtatctttgttacaggattcaataattcatgcactgaatttcccttcccggcaactccagacaccaaatcgcttcccatggtgtcccccaatcacttaggaatttagcctgtgtctaaagaccctctctgcagcctgacgtggctagccatcccagtacttccacgtttttcatgcctttctccaacagcgttgccgtggccccttaggcggcgatcgttttatcaatggtcgctccctctttttatctgttggcaggagccctttttcaacgccctcgctggagtctggcctgcacgccttgctgaatgaagccggaacctcagccccgcttccctttgaaatgaatgttcctggggcgccctctcgtggattttggagctaatcgtctgtgaatgccaagtgatggcaactgccctcccgccgcgtctccagccggtgcgggggaacgagaccctgcgggagcattaccagtacgtggggaagttggcgggcaggctgaaggaggcctccgagggcagcacgctcaccaccgtgctcttcttggtcatctgcagcttcatcgtcttggagaacctgatggttttgattgccatctggaaaaacaataaatttcacaaccgcatgtactttttcattggcaacctggctctctgcgacctgctggccggcatcgcttacaaggtcaacattctgatgtctggcaagaagacgttcagcctgtctcccacggtctggttcctcagggagggcagtatgttcgtggcccttggggcgtccacctgcagcttactggccatcgccatcgagcggcacttgacaatgatcaaaatgaggccttacgacgccaacaagaggcaccgcgtcttcctcctgatcgggatgtgctggctcattgccttcacgctgggcgccctgcccattctgggctggaactgcctgcacaatctccctgactgctctaccatcctgcccctctactccaagaagtacattgccttctgcatcagcatcttcacggccatcctggtgaccatcgtgatcctctacgcacgcatctacttcctggtgaagtccagcagccgtaaggtggccaaccacaacaactcggagcggtccatggcactgctgcggaccgtggtgattgtggtgagcgtgttcatcgcctgctggtccccactcttcatcctcttcctcattgatgtggcctgcagggtgcaggcgtgccccatcctcttcaaggctcagtggttcatcgtgttggctgtgctcaactccgccatgaacccggtcatctacacgctggccagcaaggagatgcggcgggccttcttccgtctggtctgcaactgcctggtcaggggacggggggcccgcgcctcacccatccagcctgcgctcgacccaagcagaagtaaatcaagcagcagcaacaatagcagccactctccgaaggtcaaggaagacctgccccacacagccccctcatcctgcatcatggacaagaacgcagcacttcagaatgggatcttctgcaactgatcgtctccatgcgccctgctctgcggctgtgttcttatttattgcatgcgtcgcttccacaggggcccctcaagagctgtgactcgggagagctaccttactttgaccaacagcctgcccagtgtggatgtctcttacagagggggcccaaggaatcaccaccccgcttcagtgtaaacaacgtgccttgtccactttgggctccagagtctttcagatgtactaagctgctgacatcatccactgccttctgctgcatcctagacaccctccctgttgttcacagagagggaaggtcgtgggccacacaatgctgtgtgaccctctccgtgtgcctctgaatggtgttttgatgattttacactacatttcctgtgcgtagaatggatgcttgtatattcgtacatctctatgttacacagaatttgtgttgcaggtgtttgccatgtggtacctacatagaatctccatacaacacacaggtaacaggttatacaagtggattcagactgaacccccagtacaaggacattgttttgaactaggtggacatgccatccctggtctccttagactgacatgattctcatgttaaccaagttttaaaagttcaaattccccaaaaaggcttgtccaaggctggccccagatgtgtgggtctgacccacaccagccctgtgtcctgtcctttcagtcatttgtccctgcgtaattttaatcgtattccaaagcccaattatgtgatggttttcaggtttctgcaaattacagaagagccagccaagatcacccaggagcttgtgcccccagatgggccaaagaaagagcctatgaaggagaagcagaagcagacggctggcctggctcaccttcccacgccagtggggcaggggtctgcttcaggaaatggaagctgtccaggaaatgagcagagattcacaagacagcactttgattctatgttgagtttgtttctatattagaaaagcagcaagtcagtaatcccccgtggcatcacagctaagtagctgtggccaccggcagtttcacagcatcctgaaagctggcactgatcgtgactatcagtgaaagaagtttaattttcaggttagaaaatgtgatctggcagtttatgcattcttcagagtaatgtaataatacctatgtgatgctgtaattttacttttcaacataagttgaacccgtagcagtctgtttaccttgtaaagggattacttagaagacatttttgtacatgctcttccccaaggattgtacgtattatacaaatagatggaaagaaaagtgaacacgtttgtagaactttcataagcacacagttgctgtgttgagttctctttaaaaacaaggacaaaaccaaccagcgttcaaaggaacctcccatcagagtcccctaaagtattttaggttcagtgagcatttgcctgaataaaacctaaaagagtagtcttaacacattactaactttttctaagagaaattgattcctgttttgtcatctgatgcaatttgctcttataaagagacattttcataggttcagagtaactcacctccatgggctgaccaaaggcttttctaatttttgttactgatgagatgaaacctatttgtaaggagatcttccccaggagcatttctgttgccttcttgacatcaatgaaaagtagcatattctcttatgaaatagcatgagaaaacacagggcatttctaggacagtaaaacgttaaagtactggattaagaaaacaacaacaggctgggcgcagtggctcacacctgtaatcccagcactttgggaggctgaggcgggtggatcacctgaggtcaggagtttgtgaccagcctggccaacatagtgaaatcctgtttctactaaaaatacaaaaattagctggatgcgatagcacgtgcctgtagtcccagctactcgggaggctgaggctggagagttgctcaaacccgggaggcggagattgcagtgagccaagatcgcaccgctgcactccagcctgggtgacagagcgaccctctgtctcaaaaaataataataataataaataaaacaacaacaaaatgcatcagagagccaaaacattcagtattgcattttcacataggtgatgaaatgactttggaactttatctgtgttatagttatgagttgctttgggagacttggagctctctgtagctattgttcataacactttgctccataaccctgatgtccgcagtatctaagtatctcagccttcatccattaactctactagggagcccacagccaccatttccactaggaggtatcaatatttgtggtatgacataaggctcccttgaaataacaagacttttgagcaatctgaattaaaaatacatcaaaaaagtaatagcgctcatttgctaaatgcaaaaaataatcacctttgataccaatgtgcaccaatatgcctaactagctagccagctggagataatttaccagggaatgtttcaaagccctaaccttgaagtttggaaacaggtggtcttctatgctgcagagaaactatgcattaggtctcttttcaattagaaacctttactatttccaatgtatgtttgttaaaaataataataataaaaccaaaagcctttgtggaaaccca

SEQ ID NO: 185923 - DNA, 1565 bp, Homo sapiens
  Payload ID: 16609
  Gene Symbol: S1PR4
  Gene Name: sphingosine-1-phosphate receptor 4
  Uniprot ID: O95977
  ENST ID: ENST00000246115
  CDS Start-End: 26-1180
cctcagtcagcccccgggggaggccatgaacgccacggggaccccggtggcccccgagtcctgccaacagctggcggccggcgggcacagccggctcattgttctgcactacaaccactcgggccggctggccgggcgcggggggccggaggatggcggcctgggggccctgcgggggctgtcggtggccgccagctgcctggtggtgctggagaacttgctggtgctggcggccatcaccagccacatgcggtcgcgacgctgggtctactattgcctggtgaacatcacgctgagtgacctgctcacgggcgcggcctacctggccaacgtgctgctgtcgggggcccgcaccttccgtctggcgcccgcccagtggttcctacgggagggcctgctcttcaccgccctggccgcctccaccttcagcctgctcttcactgcaggggagcgctttgccaccatggtgcggccggtggccgagagcggggccaccaagaccagccgcgtctacggcttcatcggcctctgctggctgctggccgcgctgctggggatgctgcctttgctgggctggaactgcctgtgcgcctttgaccgctgctccagccttctgcccctctactccaagcgctacatcctcttctgcctggtgatcttcgccggcgtcctggccaccatcatgggcctctatggggccatcttccgcctggtgcaggccagcgggcagaaggccccacgcccagcggcccgccgcaaggcccgccgcctgctgaagacggtgctgatgatcctgctggccttcctggtgtgctggggcccactcttcgggctgctgctggccgacgtctttggctccaacctctgggcccaggagtacctgcggggcatggactggatcctggccctggccgtcctcaactcggcggtcaaccccatcatctactccttccgcagcagggaggtgtgcagagccgtgctcagcttcctctgctgcgggtgtctccggctgggcatgcgagggcccggggactgcctggcccgggccgtcgaggctcactccggagcttccaccaccgacagctctctgaggccaagggacagctttcgcggctcccgctcgctcagctttcggatgcgggagcccctgtccagcatctccagcgtgcggagcatctgaagttgcagtcttgcgtgtggatggtgcagccaccgggtgcgtgccaggcaggccctcctggggtacaggaagctgtgtgcacgcagcctcgcctgtatggggagcagggaacgggacaggcccccatggtcttcccggtggcctctcggggcttctgacgccaaatgggcttcccatggtcaccctggacaaggaggcaaccaccccacctccccgtaggagcagagagcaccctggtgtgggggcgagtgggttccccacaaccccgcttctgtgtgattctggggaagtcccggcccctctctgggcctcagtagggctcccaggctgcaaggggtggactgtgggatgcatgccctggcaacattgaagttcgatcatggta

SEQ ID NO: 185924 - DNA, 2341 bp, Homo sapiens
  Payload ID: 16610
  Gene Symbol: S1PR5
  Gene Name: sphingosine-1-phosphate receptor 5
  Uniprot ID: Q9H228
  ENST ID: ENST00000333430
  CDS Start-End: 72-1268
ctcactcggttcaaggcagcgcgactgcgggtggcgcacgaccagggcgcagaccttggggcgcgcggcccatggagtcggggctgctgcggccggcgccggtgagcgaggtcatcgtcctgcattacaactacaccggcaagctccgcggtgcgcgctaccagccgggtgccggcctgcgcgccgacgccgtggtgtgcctggcggtgtgcgccttcatcgtgctagagaatctagccgtgttgttggtgctcggacgccacccgcgcttccacgctcccatgttcctgctcctgggcagcctcacgttgtcggatctgctggcaggcgccgcctacgccgccaacatcctactgtcggggccgctcacgctgaaactgtcccccgcgctctggttcgcacgggagggaggcgtcttcgtggcactcactgcgtccgtgctgagcctcctggccatcgcgctggagcgcagcctcaccatggcgcgcagggggcccgcgcccgtctccagtcgggggcgcacgctggcgatggcagccgcggcctggggcgtgtcgctgctcctcgggctcctgccagcgctgggctggaattgcctgggtcgcctggacgcttgctccactgtcttgccgctctacgccaaggcctacgtgctcttctgcgtgctcgccttcgtgggcatcctggccgctatctgtgcactctacgcgcgcatctactgccaggtacgcgccaacgcgcggcgcctgccggcacggcccgggactgcggggaccacctcgacccgggcgcgtcgcaagccgcgctcgctggccttgctgcgcacgctcagcgtggtgctcctggcctttgtggcatgttggggccccctcttcctgctgctgttgctcgacgtggcgtgcccggcgcgcacctgtcctgtactcctgcaggccgatcccttcctgggactggccatggccaactcacttctgaaccccatcatctacacgctcaccaaccgcgacctgcgccacgcgctcctgcgcctggtctgctgcggacgccactcctgcggcagagacccgagtggctcccagcagtcggcgagcgcggctgaggcttccgggggcctgcgccgctgcctgcccccgggccttgatgggagcttcagcggctcggagcgctcatcgccccagcgcgacgggctggacaccagcggctccacaggcagccccggtgcacccacagccgcccggactctggtatcagaaccggctgcagactgacaccctcggcccacgactgtcttcccaagttttacagacttgttctttttacataaaggaatttgtaggaaatgcagccaaaggtgcagtcggaaaagatgcaggggaaatgtatttatgcagcgacaccccacaatgtgaacaaacagacaaaaaatctgtgccctcgtggaattgacgttctgcttgggaacacagaaaagaactcggtgatgaaataatggagatgattccagtgacaaacgacagagatggtgatggtggtcagggaagacctctctgcagaggtagtgacttgtgatgtgagctgagacctctgtcctgggaagaccaaaagaaaagcatttcaggatgagggaatggcatgcgcaaaggccctgaggctgaaatgtgcccatgtgttctaagaaatgcagcgatgctggtgtgcctggagcagggacggagggggagaatgggaggagacaaggagctgaaggagtagttcccgaaggaccttgtgggtgatatagaggacttcgcttttgctctgagtgaggtgggagccatagaagcttctaagcagaagagggacttgccctaattcaggtgatcacaggtgtcttgtggcctccatgggaggttgaaaaccagagaaggtgaaggggggctgcactgagccacaggaacaatgatggagattccagctaagcccagaccccgtggattctagatagattttagaggcagcagacagaattactgaggaattgagtgtaagagtggaataaagttatcaaggacaatgccaagggtggggcacccccaaatttgactctgggagactcagccaaatcctatctggtaataaaatttcttttttatttttcttttctttctttctttcttttttttttttttgagttgggatcttgtgctctgtcacccaggctggagtgcaatgggcacaattatagctcactgcagcctggaactcctgggatcaagcctggagttcctgcttcagcctccctagtagctgggactacaggcatgcaccaccatgcccagttaataaaatttcttcaaatgca

SEQ ID NO: 185925 - DNA, 2191 bp, Homo sapiens
  Payload ID: 16610
  Gene Symbol: S1PR5
  Gene Name: sphingosine-1-phosphate receptor 5
  Uniprot ID: Q9H228
  ENST ID: ENST00000439028
  CDS Start-End: 127-1323
ggctaaggtggcccccactgaagactcctgctaagcaacccactgaagacccctccgaatcatcgacggggcgtccttggggtgcagcccaggaagctcagttcacagccttggggcgcgcggcccatggagtcggggctgctgcggccggcgccggtgagcgaggtcatcgtcctgcattacaactacaccggcaagctccgcggtgcgcgctaccagccgggtgccggcctgcgcgccgacgccgtggtgtgcctggcggtgtgcgccttcatcgtgctagagaatctagccgtgttgttggtgctcggacgccacccgcgcttccacgctcccatgttcctgctcctgggcagcctcacgttgtcggatctgctggcaggcgccgcctacgccgccaacatcctactgtcggggccgctcacgctgaaactgtcccccgcgctctggttcgcacgggagggaggcgtcttcgtggcactcactgcgtccgtgctgagcctcctggccatcgcgctggagcgcagcctcaccatggcgcgcagggggcccgcgcccgtctccagtcgggggcgcacgctggcgatggcagccgcggcctggggcgtgtcgctgctcctcgggctcctgccagcgctgggctggaattgcctgggtcgcctggacgcttgctccactgtcttgccgctctacgccaaggcctacgtgctcttctgcgtgctcgccttcgtgggcatcctggccgctatctgtgcactctacgcgcgcatctactgccaggtacgcgccaacgcgcggcgcctgccggcacggcccgggactgcggggaccacctcgacccgggcgcgtcgcaagccgcgctcgctggccttgctgcgcacgctcagcgtggtgctcctggcctttgtggcatgttggggccccctcttcctgctgctgttgctcgacgtggcgtgcccggcgcgcacctgtcctgtactcctgcaggccgatcccttcctgggactggccatggccaactcacttctgaaccccatcatctacacgctcaccaaccgcgacctgcgccacgcgctcctgcgcctggtctgctgcggacgccactcctgcggcagagacccgagtggctcccagcagtcggcgagcgcggctgaggcttccgggggcctgcgccgctgcctgcccccgggccttgatgggagcttcagcggctcggagcgctcatcgccccagcgcgacgggctggacaccagcggctccacaggcagccccggtgcacccacagccgcccggactctggtatcagaaccggctgcagactgacaccctcggcccacgactgtcttcccaagttttacagacttgttctttttacataaaggaatttgtaggaaatgcagccaaaggtgcagtcggaaaagatgcaggggaaatgtatttatgcagcgacaccccacaatgtgaacaaacagacaaaaaatctgtgccctcgtggaattgacgttctgcttgggaacacagaaaagaactcggtgatgaaataatggagatgattccagtgacaaacgacagagatggtgatggtggtcagggaagacctctctgcagaggtagtgacttgtgatgtgagctgagacctctgtcctgggaagaccaaaagaaaagcatttcaggatgagggaatggcatgcgcaaaggccctgaggctgaaatgtgcccatgtgttctaagaaatgcagcgatgctggtgtgcctggagcagggacggagggggagaatgggaggagacaaggagctgaaggagtagttcccgaaggaccttgtgggtgatatagaggacttcgcttttgctctgagtgaggtgggagccatagaagcttctaagcagaagagggacttgccctaattcaggtgatcacaggtgtcttgtggcctccatgggaggttgaaaaccagagaaggtgaaggggggctgcactgagccacaggaacaatgatggagattccagctaagcccagaccccgtggattctagatagattttagaggcagcagacagaattactgaggaattgagtgtaagagtggaataaagttatcaaggacaatgccaagggtggggcacccccaaatttgactctgggagactcagccaaatcctatctggtaataaaatttcttttttattttt

SEQ ID NO: 185926 - DNA, 565 bp, Homo sapiens
  Payload ID: 16610
  Gene Symbol: S1PR5
  Gene Name: sphingosine-1-phosphate receptor 5
  ENST ID: ENST00000590601
  CDS Start-End: 340-565
actgcgggtggcgcacgaccagggcgcagagtgagtggactgcactggacctttgggggcgctgggctgggcctgacccggagggggtcgccctggcggccactttcccggtctaaaaaggcgcaccactccttgcagggagttctccgaacttttcctggaggcctctggggagggggaagctgggggctccccagctgggtgcaggacctgggatacggggtgaaggtggctggaatcccctggccaccccctcctggccgggccactgcaagtttccatacttcagtcctgctgccgggcaagctgggcggatggggttggcctccccctcagagcatgtgtaaccctgtctccctgtatttgggctccccacctccagcatggccttggggcgcgcggcccatggagtcggggctgctgcggccggcgccggtgagcgaggtcatcgtcctgcattacaactacaccggcaagctccgcggtgcgcgctaccagccgggtgccggcctgcgcgccgacgccgtggtgtgcctggcggtgtgcgccttcatcgtgctagaga

SEQ ID NO: 185927 - DNA, 1698 bp, Homo sapiens
  Payload ID: 16610
  Gene Symbol: S1PR5
  Gene Name: sphingosine-1-phosphate receptor 5
  ENST ID: ENST00000617721
  CDS Start-End: 11-775
cgcgcggcccatggagtcggggctgctgcggccggcgccggtgagcgaggtcatcgtcctgcattacaactacaccggcaagctccgcggtgcgcgctaccagccgggtgccggcctgcgcgccgacgccgtggtgtgcctggcggtgtgcgccttcatcgtgctagagaatctagccgtgttgttggtgctcggacgccacccgcgcttccacgctcccatgttcctgctcctgggcagcctcacgttgtcggatctggcacggcccgggactgcggggaccacctcgacccgggcgcgtcgcaagccgcgctcgctggccttgctgcgcacgctcagcgtggtgctcctggcctttgtggcatgttggggccccctcttcctgctgctgttgctcgacgtggcgtgcccggcgcgcacctgtcctgtactcctgcaggccgatcccttcctgggactggccatggccaactcacttctgaaccccatcatctacacgctcaccaaccgcgacctgcgccacgcgctcctgcgcctggtctgctgcggacgccactcctgcggcagagacccgagtggctcccagcagtcggcgagcgcggctgaggcttccgggggcctgcgccgctgcctgcccccgggccttgatgggagcttcagcggctcggagcgctcatcgccccagcgcgacgggctggacaccagcggctccacaggcagccccggtgcacccacagccgcccggactctggtatcagaaccggctgcagactgacaccctcggcccacgactgtcttcccaagttttacagacttgttctttttacataaaggaatttgtaggaaatgcagccaaaggtgcagtcggaaaagatgcaggggaaatgtatttatgcagcgacaccccacaatgtgaacaaacagacaaaaaatctgtgccctcgtggaattgacgttctgcttgggaacacagaaaagaactcggtgatgaaataatggagatgattccagtgacaaacgacagagatggtgatggtggtcagggaagacctctctgcagaggtagtgacttgtgatgtgagctgagacctctgtcctgggaagaccaaaagaaaagcatttcaggatgagggaatggcatgcgcaaaggccctgaggctgaaatgtgcccatgtgttctaagaaatgcagcgatgctggtgtgcctggagcagggacggagggggagaatgggaggagacaaggagctgaaggagtagttcccgaaggaccttgtgggtgatatagaggacttcgcttttgctctgagtgaggtgggagccatagaagcttctaagcagaagagggacttgccctaattcaggtgatcacaggtgtcttgtggcctccatgggaggttgaaaaccagagaaggtgaaggggggctgcactgagccacaggaacaatgatggagattccagctaagcccagaccccgtggattctagatagattttagaggcagcagacagaattactgaggaattgagtgtaagagtggaataaagttatcaaggacaatgccaagggtggggcacccccaaatttgactctgggagactcagccaaatcctatctggtaataaaatttcttttttatttttcttttctttctttctttcttttttttttttttgagttgggatcttgtgctctgtc

SEQ ID NO: 185928 - DNA, 6804 bp, Homo sapiens
  Payload ID: 16611
  Gene Symbol: SPHKAP
  Gene Name: SPHK1 interactor, AKAP domain containing
  Uniprot ID: Q2M3C7
  ENST ID: ENST00000344657
  CDS Start-End: 29-5044
gtctttcttctctgggcgcccaccaacaatggatggcaactccctgctctcggtaccaagcaacttggagtcatcacggatgtatgacgttttggaaccgcagcagggcagaggctgtggcagctcaggaagcggcccggggaactccatcacagcctgtaagaaggttcttcgcagcaatagcctgctggagtcaacagactactggttgcagaatcagaggatgccctgccaaattggttttgtagaagacaagtctgaaaactgtgcttctgtctgctttgtgaatcttgatgtgaacaaggatgaatgcagcacagagcacctgcaacagaaactggtcaacgtttcaccagatcttccaaaacttatcagttccatgaatgtccaacaaccaaaagaaaatgaaattgttgtcctaagtgggttagcctctggaaatctccaggcagattttgaagtttcacagtgcccttggctgccagatatctgcttggtccaatgtgcaagagggaacagaccaaacagtaccaactgcatcatctttgaaatcaacaaatttctgattggtctggaactggtgcaggagcgacagctccacctggaaacaaacatcttgaaactggaggatgacacgaactgttccttatcttcaatcgaggaagactttctcaccgcttctgagcacttggaggaggaaagcgaggtggatgaatctaggaacgattatgaaaatataaatgtctcagccaatgttttggaaagtaaacagctaaagggagccacccaggtggaatggaattgcaacaaggaaaagtggctttatgctttggaagacaaatacatcaacaaatatcccacaccattgattaaaacagaacgatctccagaaaacctaacaaagaacacagccttgcagagtctagatccctcagccaagccatcacagtggaaaagagaagctgtggggaatgggagacaagccacacattattatcattcagaagcttttaaaggtcaaatggaaaaatcacaggcactgtatattccaaaagatgcttatttctccatgatggataaagatgtaccttctgcatgtgctgtggcagagcagagaagcaacctaaacccaggagaccatgaagacacaagaaacgctctccctcctagacaagatggagaagtcaccactggcaagtatgctacaaatttagcagaatccgtgctgcaggatgcatttattagattatctcaatctcagtccacattaccccaggaatctgcagtcagtgtttctgtaggaagttctctgcttcccagttgctattccacaaaagatacagtggtttctcggtcatggaatgagctccccaaaatcgtcgttgttcagagtccagatggcagtgatgctgccccacagccaggcatctcctcctggcctgagatggaagtctctgttgaaacctcaagcatcctctctggagagaactccagcagacaaccccagagtgctctagaagtggcgttagcttgtgcagccactgtgattggaactatttccagtccacaggccacagaaagactcaaaatggagcaagtggtctcgaactttcccccagggagcagtggtgcactgcaaactcaagcaccccaaggactcaaggaaccttccatcaatgagtactcctttccatctgctttgtgtggcatgactcaggtggccagtgccgtggctgtctgtggtctgggtgaaagagaagaggtgacatgctcagtggctccaagtggtagcctcccgcctgcagctgaggcttctgaagccatgcccccactttgtggtttagcaagcatggagcttggcaaggaagccattgccaagggattgctcaaggaggctgctctggttttaacaaggcctaatacctacagcagcattggagactttctggactccatgaacaggagaatcatggaaactgcttcaaagtctcagaccctgtgctcagaaaatgtcgtcaggaatgaactggcacataccctgtccaatgttatcctgaggcattccattgatgaagttcaccacaaaaatatgataatcgaccccaatgacaacaggcattcatctgaaattctggacaccttaatggaaagtacaaatcaactgcttttagatgtgatatgcttcacgttcaagaagatgagtcatattgtacggcttggtgaatgtcctgctgtcctttctaaggagaccatcagaaggagggagacagaaccaagctgccagccatctgatccgggtgctagtcaagcttggacaaaagccactgaatcctccagcagctctccacttagcaattcacacaacacgagtcttgtcatcaacaatcttgtggatggcatgtattcaaaacaagacaagggtggagtgaggccaggcctcttcaagaaccccacgctgcagtcacaattatcacgtagtcacagagtgcccgattcttcaactgctacaacatcctccaaggaaatatatctgaaaggaatagcaggagaggatacaaaaagccctcatcacagtgagaatgaatgcagagcctcttccgaaggacaaaggtccccaacggtcagccagtccagaagtggttcccaggaggctgaggagagtatccacccaaacacccaagaaaagtacaactgtgccacatctcgcatcaacgaagttcaagtcaacctgtccttgttaggggatgacctgctgcttcctgctcaatccacgcttcaaacaaagcatccagacatctactgcattacagactttgcggaagaattagcagacacggtcgtctccatggcaactgaaattgcagcgatttgccttgacaactccagtggaaaacaaccctggttttgtgcatggaaaagagggagtgagtttctgatgacacccaacgtaccctgccgatccttgaagaggaagaaagagagccaggggagcgggaccgctgtgaggaaacacaagcctccccggctcagtgagatcaagaggaagacggacgagcaccctgagcttaaagaaaagctgatgaacagggttgtggatgagtccatgaaccttgaagatgtcccagattctgtcaatctttttgccaatgaagtggcagccaagatcatgaacctaacggagttctctatggtggacggcatgtggcaggcgcagggctatccccggaatcggttactgagtggcgacaggtggagccggctgaaggcctccagctgcgaaagcattcctgaggaagactccgaggccagggcctatgtcaacagcctgggcttaatgagcacgctgagccagccggtcagcagggccagctctgtctccaagcagtcgagctgtgagagcatcaccgatgagttttccaggttcatggtgaaccagatggaaaatgaagggagaggatttgagttactgctggattactatgctggcaagaacgccagcagcattctgaactcagccatgcaacaggcgtgccggaaaagtgaccacctcagtgtgaggcctagctgtccctctaagcagtccagcacagagagcatcactgaggagttctacaggtacatgctgagggacatcgaaagagacagcagagaaagtgcctcctccagacggagcagccaggattggacagccggcctgctgtctccttctctgcgatccccagtgtgccacagacagtcgtccatgccagacagcagatccccatgctccaggctgacagtgaatgtgcccatcaaagccaactctttagatggctttgctcagaactgcccacaagatttcctaagcgtgcagccggtcagtagcgcgtcctcatccggtctctgcaaatctgactcttgcttgtatcggagaggtgggactgaccacatcaccaacatgttaattcatgaaacgtgggctagctccattgaggctctcatgcgcaagaacaaaatcattgtggatgatgcagaggaagctgacactgagcctgtttctggtggctctccctcgcaagcagagaagtgtgcaaatagattagctgcgagcaggatgtgcagtgggccaactctgcttgttcaggagtctctcgattgcccgaggaaagactctgttaccgaatgtaaacagcccccagtgtcatctttgagcaaaactgcttctcttacaaaccacagccctttagattctaaaaaagaaacttcctcgtgccaggaccctgtaccaataaaccacaaaaggcgatcactttgctcgagggaagtgcctttgattcagattgaaacagatcagagagaagcctgtgctggggaacctgaacccttcctttccaaaagcagcctcctagaggaagcagaagggcattcgaatgacaaaaacatcccagatgtggtgagaggtggagacacagccgtgagcgcttgtcaaatccatagtgacagccttgataccagagatgtaccagaggctgaagcctccacagaagccagagcccccgatgaggcccccaaccctccaagcagcagcgaggagagcacaggcagctggacccagcttgccaatgaggaagacaacccagatgacacaagtagctttctccagctcagtgagcgatccatgagtgaattagtagaagaaaagaagattcttaaaggacagtcagaaagcacagaggcacctgcatctggaccgcctacgggaacagccagcccccagaggagcctgctggtgatcaactttgacctggagccagagtgtccagatgccgagctccgagccactctgcagtggatagctgcctctgaactggggattcccaccatctactttaagaaatctcaggaaaacagaattgaaaagtttctagatgtcgtgcagctggttcatcggaagtcctggaaagtgggtgatatcttccatgcagttgtccagtactgcaaaatgcatgaggagcagaaggatgggagactgagtctctttgactggctcttggaactgggataataaggcagtctgccgtatagatcattccttccctttattccaacttagattacagtggtttgttctaaatgctctaaacattctcaaaacatcacatcacattagcagaactataaaaaaaaatctgctactcagatccactgcatacagaataagtcagaggaaaagcaaaatataggtctgtccaaattcatacaacttgtgggtgagttccaaagagcttggattagaagggctggacaaagagagaattcaatggggcccaaattagaatgcttataatgagacccaatctccaggaaaacaacactcacataagtttaatcatataaaatgatttgtaatgtctctaattagatgaatcaactagaaacaaactcagtggtcaaaataatttttaagagtattccgtaacctatattttacttttctgattatattaaggggctgccagcccggagaaatacttaagatatgggtgagaaatccccagacttttatacaaaagatttccactttcaaatcaatgtcagtagacattgataaaagtatagcagcatcctctactgaggtgatttcatttattccctgcagcccactgataaatatctcacttctcccaaatagtatgtggactcccagctaagcagaaaactattgtcattcaactgaagaagaggaagataaaagattgtcttgtttccatcactgtattacttgtgtaacatgattacataattcttatcctaagagaaagctttcatatttaaaaaaaagtcttttcagataaaatctgcttgtgtcttgaataatatgaaatacaaactttcactttattttattgtaaattataaagagattattgtcttaaataatatattgagttagcttcaagcttcctaaaatatgaagagattgttgtctaaagtcacatattgacattgagctcagtggcctgtttcatcacgtatgtgctgctacctgtacagcagacatgccgctccagtgacatttataatgacagaagcagggtaatggtcttgtgtttgacatgatcagttaggatcatagactttccctgactcgtagatattagccttgaattgggggaaaagaagactttgacacattttagttattttaataacagagatttactcttttgaaaaataaaggtatctaatgtctccctaataagtcttctttccttccaactaaatgacctacacggacttttattttcttgatcaaagaggtgtttattaaggacttctggataactatacttttactctatttttaaagatcacaaagtaattttaaatgtgaacaggttcccataccatgaatgctggcctcaccttctctatcatccacattttgaaatgcaaagaaagctcccttgtaagccatacttccttccccactcccatcctaggatacttgcccagtgctcattaggcatttcttattcagatagtccaaatttaggttattatgcttaatttgacacattaactaaatgcccagttttaaaatatatccatcaattcacgctgaaatgtgcttctttgtgctatcaaatggaatagaatacacttattttttaaacaatcccagaatactgtgtgtagacttttgttgtgctcaaataaatgtttacttatcttacaaagctcaaatactggattgtaaccatgtgatgaagttatctatgttgtacctaacattgcaaattaatcaataaatctctgttgtca

SEQ ID NO: 185929 - DNA, 6917 bp, Homo sapiens
  Payload ID: 16611
  Gene Symbol: SPHKAP
  Gene Name: SPHK1 interactor, AKAP domain containing
  Uniprot ID: Q2M3C7
  ENST ID: ENST00000392056
  CDS Start-End: 48-5150
tccttcgcctgcactttccgtctttcttctctgggcgcccaccaacaatggatggcaactccctgctctcggtaccaagcaacttggagtcatcacggatgtatgacgttttggaaccgcagcagggcagaggctgtggcagctcaggaagcggcccggggaactccatcacagcctgtaagaaggttcttcgcagcaatagcctgctggagtcaacagactactggttgcagaatcagaggatgccctgccaaattggttttgtagaagacaagtctgaaaactgtgcttctgtctgctttgtgaatcttgatgtgaacaaggatgaatgcagcacagagcacctgcaacagaaactggtcaacgtttcaccagatcttccaaaacttatcagttccatgaatgtccaacaaccaaaagaaaatgaaattgttgtcctaagtgggttagcctctggaaatctccaggcagattttgaagtttcacagtgcccttggctgccagatatctgcttggtccaatgtgcaagagggaacagaccaaacagtaccaactgcatcatctttgaaatcaacaaatttctgattggtctggaactggtgcaggagcgacagctccacctggaaacaaacatcttgaaactggaggatgacacgaactgttccttatcttcaatcgaggaagactttctcaccgcttctgagcacttggaggaggaaagcgaggtggatgaatctaggaacgattatgaaaatataaatgtctcagccaatgttttggaaagtaaacagctaaagggagccacccaggtggaatggaattgcaacaaggaaaagtggctttatgctttggaagacaaatacatcaacaaatatcccacaccattgattaaaacagaacgatctccagaaaacctaacaaagaacacagccttgcagagtctagatccctcagccaagccatcacagtggaaaagagaagctgtggggaatgggagacaagccacacattattatcattcagaagcttttaaaggtcaaatggaaaaatcacaggcactgtatattccaaaagatgcttatttctccatgatggataaagatgtaccttctgcatgtgctgtggcagagcagagaagcaacctaaacccaggagaccatgaagacacaagaaacgctctccctcctagacaagatggagaagtcaccactggcaagtatgctacaaatttagcagaatccgtgctgcaggatgcatttattagattatctcaatctcagtccacattaccccaggaatctgcagtcagtgtttctgtaggaagttctctgcttcccagttgctattccacaaaagatacagtggtttctcggtcatggaatgagctccccaaaatcgtcgttgttcagagtccagatggcagtgatgctgccccacagccaggcatctcctcctggcctgagatggaagtctctgttgaaacctcaagcatcctctctggagagaactccagcagacaaccccagagtgctctagaagtggcgttagcttgtgcagccactgtgattggaactatttccagtccacaggccacagaaagactcaaaatggagcaagtggtctcgaactttcccccagggagcagtggtgcactgcaaactcaagcaccccaaggactcaaggaaccttccatcaatgagtactcctttccatctgctttgtgtggcatgactcaggtggccagtgccgtggctgtctgtggtctgggtgaaagagaagaggtgacatgctcagtggctccaagtggtagcctcccgcctgcagctgaggcttctgaagccatgcccccactttgtggtttagcaagcatggagcttggcaaggaagccattgccaagggattgctcaaggaggctgctctggttttaacaaggcctaatacctacagcagcattggagactttctggactccatgaacaggagaatcatggaaactgcttcaaagtctcagaccctgtgctcagaaaatgtcgtcaggaatgaactggcacataccctgtccaatgttatcctgaggcattccattgatgaagttcaccacaaaaatatgataatcgaccccaatgacaacaggcattcatctgaaattctggacaccttaatggaaagtacaaatcaactgcttttagatgtgatatgcttcacgttcaagaagatgagtcatattgtacggcttggtgaatgtcctgctgtcctttctaaggagaccatcagaaggagggagacagaaccaagctgccagccatctgatccgggtgctagtcaagcttggacaaaagccactgaatcctccagcagctctccacttagcaattcacacaacacgagtcttgtcatcaacaatcttgtggatggcatgtattcaaaacaagacaagggtggagtgaggccaggcctcttcaagaaccccacgctgcagtcacaattatcacgtagtcacagagtgcccgattcttcaactgctacaacatcctccaaggaaatatatctgaaaggaatagcaggagaggatacaaaaagccctcatcacagtgagaatgaatgcagagcctcttccgaaggacaaaggtccccaacggtcagccagtccagaagtggttcccaggaggctgaggagagtatccacccaaacacccaagaaaagtacaactgtgccacatctcgcatcaacgaagttcaagtcaacctgtccttgttaggggatgacctgctgcttcctgctcaatccacgcttcaaacaaagcatccagacatctactgcattacagactttgcggaagaattagcagacacggtcgtctccatggcaactgaaattgcagcgatttgccttgacaactccagtggaaaacaaccctggttttgtgcatggaaaagagggagtgagtttctgatgacacccaacgtaccctgccgatccttgaagaggaagaaagagagccaggggagcgggaccgctgtgaggaaacacaagcctccccggctcagtgagatcaagaggaagacggacgagcaccctgagcttaaagaaaagctgatgaacagggttgtggatgagtccatgaaccttgaagatgtcccagattctgtcaatctttttgccaatgaagtggcagccaagatcatgaacctaacggagttctctatggtggacggcatgtggcaggcgcagggctatccccggaatcggttactgagtggcgacaggtggagccggctgaaggcctccagctgcgaaagcattcctgaggaagactccgaggccagggcctatgtcaacagcctgggcttaatgagcacgctgagccagccggtcagcagggccagctctgtctccaagcagtcgagctgtgagagcatcaccgatgagttttccaggttcatggtgaaccagatggaaaatgaagggagaggatttgagttactgctggattactatgctggcaagaacgccagcagcattctgaactcagccatgcaacaggcgtgccggaaaagtgaccacctcagtgtgaggcctagctgtccctctaagcagtccagcacagagagcatcactgaggagttctacaggtacatgctgagggacatcgaaagagacagcagagaaagtgcctcctccagacggagcagccaggattggacagccggcctgctgtctccttctctgcgatccccagtgtgccacagacagtcgtccatgccagacagcagatccccatgctccaggctgacagtgaatgtgcccatcaaagccaactctttagatggctttgctcagaactgcccacaagatttcctaagcgtgcagccggtcagtagcgcgtcctcatccggtctctgcaaatctgactcttgcttgtatcggagaggtgggactgaccacatcaccaacatgttaattcatgaaacgtgggctagctccattgaggctctcatgcgcaagaacaaaatcattgtggatgatgcagaggaagctgacactgagcctgtttctggtggctctccctcgcaagcagagaagtgtgcaaatagattagctgcgagcaggatgtgcagtgggccaactctgcttgttcaggagtctctcgattgcccgaggaaagactctgttaccgaatgtaaacagcccccagtgtcatctttgagcaaaactgcttctcttacaaaccacagccctttagattctaaaaaagaaacttcctcgtgccaggaccctgtaccaataaaccacaaaaggcgatcactttgctcgagggaagtgcctttgattcagattgaaacagatcagagagaagcctgtgctggggaacctgaacccttcctttccaaaagcagcctcctagaggaagcagaagggcattcgaatgacaaaaacatcccagatgtggtgagaggtggagacacagccgtgagcgcttgtcaaatccatagtgacagccttgataccagagatgtaccagaggctgaagcctccacagaagccagagcccccgatgaggcccccaaccctccaagcagcagcgaggagagcacaggcagctggacccagcttgccaatgaggaagacaacccagatgacacaagtagctttctccagctcagtgagcgatccatgagcaatggcaacagtagtgccactagcagtcttggcattatggatctggacatttatcaggaaagcatgccatcttctcccatgattaatgaattagtagaagaaaagaagattcttaaaggacagtcagaaagcacagaggcacctgcatctggaccgcctacgggaacagccagcccccagaggagcctgctggtgatcaactttgacctggagccagagtgtccagatgccgagctccgagccactctgcagtggatagctgcctctgaactggggattcccaccatctactttaagaaatctcaggaaaacagaattgaaaagtttctagatgtcgtgcagctggttcatcggaagtcctggaaagtgggtgatatcttccatgcagttgtccagtactgcaaaatgcatgaggagcagaaggatgggagactgagtctctttgactggctcttggaactgggataataaggcagtctgccgtatagatcattccttccctttattccaacttagattacagtggtttgttctaaatgctctaaacattctcaaaacatcacatcacattagcagaactataaaaaaaaatctgctactcagatccactgcatacagaataagtcagaggaaaagcaaaatataggtctgtccaaattcatacaacttgtgggtgagttccaaagagcttggattagaagggctggacaaagagagaattcaatggggcccaaattagaatgcttataatgagacccaatctccaggaaaacaacactcacataagtttaatcatataaaatgatttgtaatgtctctaattagatgaatcaactagaaacaaactcagtggtcaaaataatttttaagagtattccgtaacctatattttacttttctgattatattaaggggctgccagcccggagaaatacttaagatatgggtgagaaatccccagacttttatacaaaagatttccactttcaaatcaatgtcagtagacattgataaaagtatagcagcatcctctactgaggtgatttcatttattccctgcagcccactgataaatatctcacttctcccaaatagtatgtggactcccagctaagcagaaaactattgtcattcaactgaagaagaggaagataaaagattgtcttgtttccatcactgtattacttgtgtaacatgattacataattcttatcctaagagaaagctttcatatttaaaaaaaagtcttttcagataaaatctgcttgtgtcttgaataatatgaaatacaaactttcactttattttattgtaaattataaagagattattgtcttaaataatatattgagttagcttcaagcttcctaaaatatgaagagattgttgtctaaagtcacatattgacattgagctcagtggcctgtttcatcacgtatgtgctgctacctgtacagcagacatgccgctccagtgacatttataatgacagaagcagggtaatggtcttgtgtttgacatgatcagttaggatcatagactttccctgactcgtagatattagccttgaattgggggaaaagaagactttgacacattttagttattttaataacagagatttactcttttgaaaaataaaggtatctaatgtctccctaataagtcttctttccttccaactaaatgacctacacggacttttattttcttgatcaaagaggtgtttattaaggacttctggataactatacttttactctatttttaaagatcacaaagtaattttaaatgtgaacaggttcccataccatgaatgctggcctcaccttctctatcatccacattttgaaatgcaaagaaagctcccttgtaagccatacttccttccccactcccatcctaggatacttgcccagtgctcattaggcatttcttattcagatagtccaaatttaggttattatgcttaatttgacacattaactaaatgcccagttttaaaatatatccatcaattcacgctgaaatgtgcttctttgtgctatcaaatggaatagaatacacttattttttaaacaatcccagaatactgtgtgtagacttttgttgtgctcaaataaatgtttacttatcttacaaagctcaaatactggattgtaaccatgtgatgaagttatctatgttgtacctaacattgcaaattaatcaataaatctctgttgtcagattgtt

SEQ ID NO: 185930 - DNA, 1168 bp, Homo sapiens
  Payload ID: 16612
  Gene Symbol: SPI1
  Gene Name: Spi-1 proto-oncogene
  Uniprot ID: P17947
  ENST ID: ENST00000227163
  CDS Start-End: 39-854
ccgaggcaggggatctgaccgactcggagcccggctggatgttacaggcgtgcaaaatggaagggtttcccctcgtcccccctcagccatcagaagacctggtgccctatgacacggatctataccaacgccaaacgcacgagtattacccctatctcagcagtgatggggagagccatagcgaccattactgggacttccacccccaccacgtgcacagcgagttcgagagcttcgccgagaacaacttcacggagctccagagcgtgcagcccccgcagctgcagcagctctaccgccacatggagctggagcagatgcacgtcctcgatacccccatggtgccaccccatcccagtcttggccaccaggtctcctacctgccccggatgtgcctccagtacccatccctgtccccagcccagcccagctcagatgaggaggagggcgagcggcagagccccccactggaggtgtctgacggcgaggcggatggcctggagcccgggcctgggctcctgcctggggagacaggcagcaagaagaagatccgcctgtaccagttcctgttggacctgctccgcagcggcgacatgaaggacagcatctggtgggtggacaaggacaagggcaccttccagttctcgtccaagcacaaggaggcgctggcgcaccgctggggcatccagaagggcaaccgcaagaagatgacctaccagaagatggcgcgcgcgctgcgcaactacggcaagacgggcgaggtcaagaaggtgaagaagaagctcacctaccagttcagcggcgaagtgctgggccgcgggggcctggccgagcggcgccacccgccccactgagcccgcagcccccgccgggccccgccaggcctccccgctggccatagcattaagccctcgcccggcccggacacagggaggacgctcccggggcccagaggcaggactgtggcgggccgggcctcgcctcacccgccccctccccccactccaggccccctccacatcccgcttcgcctccctccaggactccaccccggctcccggacgccagctgggcgtcagaccccaccggggcaaccttgcagaggacgacccggggtactgccttgggagtctcaagtccgtatgtaaatcagatctcccctctcacc

SEQ ID NO: 185931 - DNA, 1403 bp, Homo sapiens
  Payload ID: 16612
  Gene Symbol: SPI1
  Gene Name: Spi-1 proto-oncogene
  Uniprot ID: P17947
  ENST ID: ENST00000378538
  CDS Start-End: 224-1036
gactatctcccagcggcaggcccttcgataaaatcaggaacttgtgctggccctgcaatgtcaagggagggggctcacccagggctcctgtagctcagggggcaggcctgagccctgcacccgccccacgaccgtccagcccctgacggggcaccccatcctgaggggctctgcattggcccccaccgaggcaggggatctgaccgactcggagcccggctggatgttacaggcgtgcaaaatggaagggtttcccctcgtcccccctccatcagaagacctggtgccctatgacacggatctataccaacgccaaacgcacgagtattacccctatctcagcagtgatggggagagccatagcgaccattactgggacttccacccccaccacgtgcacagcgagttcgagagcttcgccgagaacaacttcacggagctccagagcgtgcagcccccgcagctgcagcagctctaccgccacatggagctggagcagatgcacgtcctcgatacccccatggtgccaccccatcccagtcttggccaccaggtctcctacctgccccggatgtgcctccagtacccatccctgtccccagcccagcccagctcagatgaggaggagggcgagcggcagagccccccactggaggtgtctgacggcgaggcggatggcctggagcccgggcctgggctcctgcctggggagacaggcagcaagaagaagatccgcctgtaccagttcctgttggacctgctccgcagcggcgacatgaaggacagcatctggtgggtggacaaggacaagggcaccttccagttctcgtccaagcacaaggaggcgctggcgcaccgctggggcatccagaagggcaaccgcaagaagatgacctaccagaagatggcgcgcgcgctgcgcaactacggcaagacgggcgaggtcaagaaggtgaagaagaagctcacctaccagttcagcggcgaagtgctgggccgcgggggcctggccgagcggcgccacccgccccactgagcccgcagcccccgccgggccccgccaggcctccccgctggccatagcattaagccctcgcccggcccggacacagggaggacgctcccggggcccagaggcaggactgtggcgggccgggcctcgcctcacccgccccctccccccactccaggccccctccacatcccgcttcgcctccctccaggactccaccccggctcccggacgccagctgggcgtcagaccccaccggggcaaccttgcagaggacgacccggggtactgccttgggagtctcaagtccgtatgtaaatcagatctcccctctcacccctcccacccattaacctcctcccaaaaaacaagtaaagttattctcaatcca

SEQ ID NO: 185932 - DNA, 1290 bp, Homo sapiens
  Payload ID: 16612
  Gene Symbol: SPI1
  Gene Name: Spi-1 proto-oncogene
  ENST ID: ENST00000533968
  CDS Start-End: 135-872
gtagctcagggggcaggcctgagccctgcacccgccccacgaccgtccagcccctgacggggcaccccatcctgaggggctctgcattggcccccaccgaggcaggggatctgaccgactcggagcccggctggatgttacaggcgtgcaaaatggaagggtttcccctcgtcccccctccatcagaagacctggtgccctatgacacggatctataccaacgccaaacgcacgagtattacccctatctcagcagtgatggggagagccatagcgaccattactgggacttccacccccaccacgtgcacagcgagttcgagagcttcgccgagaacaacttcacggagctccagagcgtgcagcccccgcagctgcagcagctctaccgccacatggagctggagcagatgcacgtcctcgatacccccatggtgccaccccatcccagtcttggccaccaggtctcctacctgccccggatgtgcctccagtacccatccctgtccccagcccagcccagctcagatgaggaggagggcgagcggcagagccccccactggaggtgtctgacggcgaggcggatggcctggagcccgggcctgggctcctgcctggggagacaggtggggcacctggccctccaccctggccccgaccctggccgtgtctgtgccctgcccccacccagccaggccaactgacccagcagccacgccaccgagtcgcgtgtgtgtgtgtgtgcatgtttgccagtgtgtgtgttttgtggggctgtctgtggctgtctctgtgtgtgtgtatctgctgtgtagtgcatacgggcatctccatgaagtgtgccaggtgtgtgtgtctctctgtgccatgagtgtgtgtacatctgggtgtgtgtgagcaagtgtgcagagggtgcgtgtgcacaggtacgggcaggtgcatgtgtgcgagtggctgtgtgagtgggtgtgtgagaaggtgaatgtgagagctggtgtggctgagagtgggtgtggccatgtttgtgtgtctgtcaacacatgaatgtatttcagtgcgtgtgagcagctgtgcacgtatgatgtcagtgggtgtcagcagtgtgtgggtgtgcctgtgtgagcagggatgtgagcatggtatatgtgagtggctgtaagcaggcatgtgtgagtgatatgtgtgagtgggggtgtgacagcaggtgtgtgagcaagtgtatatgtgtgaatgtgtatgtaagcagggatgtgtgtgatataagtgtgtgtgaatgggcataggtgtgt

SEQ ID NO: 185933 - DNA, 661 bp, Homo sapiens
  Payload ID: 16612
  Gene Symbol: SPI1
  Gene Name: Spi-1 proto-oncogene
  ENST ID: ENST00000533030
  CDS Start-End: 171-278
tgcaatgtcaagggagggggctcacccagggctcctgtagctcagggggcaggcctgagccctgcacccgccccacgaccgtccagcccctgacggggcaccccatcctgaggggctctgcattggcccccaccgaggcaggggatctgaccgactcggagcccggctggatgttacaggcgtgcaaaatggaagggtttcccctcgtcccccctgcagcaagaagaagatccgcctgtaccagttcctgttggacctgctccgcagcggcgacatgaaggacagcatctggtgggtggacaaggacaagggcaccttccagttctcgtccaagcacaaggaggcgctggcgcaccgctggggcatccagaagggcaaccgcaagaagatgacctaccagaagatggcgcgcgcgctgcgcaactacggcaagacgggcgaggtcaagaaggtgaagaagaagctcacctaccagttcagcggcgaagtgctgggccgcgggggcctggccgagcggcgccacccgccccactgagcccgcagcccccgccgggccccgccaggcctccccgctggccatagcattaagccctcgcccggcccggacacagggaggacgctcccggggcccagaggcaggactgtggcgggccgggcctcg

SEQ ID NO: 185934 - DNA, 1443 bp, Homo sapiens
  Payload ID: 16613
  Gene Symbol: SPIB
  Gene Name: Spi-B transcription factor (Spi-1/PU.1 related)
  Uniprot ID: Q01892
  ENST ID: ENST00000270632
  CDS Start-End: 6-539
ccaccatgctcgccctggaggctgcacagctcgacgggccacacttcagctgtctgtacccagatggcgtcttctatgacctggacagctgcaagcattccagctaccctgattcagagggggctcctgactccctgtgggactggactgtggccccacctgtcccagccaccccctatgaagccttcgacccggcagcagccgcttttagccacccccaggctgcccagctctgctacgaaccccccacctacagccctgcagggaacctcgaactggcccccagcctggaggccccggggcctggcctccctgcataccccacggagaacttcgctagccagaccctggttcccccggcatatgccccgtaccccagccctgtgctatcagaggaggaagacttaccgttggacagccctgccctggaggtctcggacagcgagtcggatgaggccctcgtggctggccccgaggggaagggatccgagggactcgcaagaagctgcgcctgtaccagttcctgctggggctactgacgcgcggggacatgcgtgagtgcgtgtggtgggtggagccaggcgccggcgtcttccagttctcctccaagcacaaggaactcctggcgcgccgctggggccagcagaaggggaaccgcaagcgcatgacctaccagaagctggcgcgcgccctccgaaactacgccaagaccggcgagatccgcaaggtcaagcgcaagctcacctaccagttcgacagcgcgctgctgcctgcagtccgccgggcctgagcacacccgaggctcccacctgcggagccgctgggggacctcacgtcccagccaggatccccctggaagaaaaagggcgtccccacactctaggtgataggacttacgcatccccaccttttggggtaaggggagtgctgccctgccataatccccaagcccagcccgggcctgtctgggattccccacttgtgcctggggtcctctgggatttctttgtcatgtacagactccctgggatcctcatgttttgggtgacaggacctatggaccactatactcggggaggcagggtagcagttcttccagaatcccaagagcttctctgggattttcttgtgatatctgattccccagtgaggcctgggacgtttttaagatcgctgtgtgtctgtaaaccctgaatctcatctggggtgggggccctgctggcaaccctgagccctgtccaaggttccctcttgtcagatctgagatttcctagttatgtctggggccctctgggagctgttatcatctcagatctcttcgcccatctatggctgtgttgtcacatctgtcccctcatttttgagatcccccaattctctggaactattctgctgcccctttttatgtgtctggagttccccaatcacatctagggctcctcc

SEQ ID NO: 185935 - DNA, 3311 bp, Homo sapiens
  Payload ID: 16613
  Gene Symbol: SPIB
  Gene Name: Spi-B transcription factor (Spi-1/PU.1 related)
  Uniprot ID: Q01892
  ENST ID: ENST00000439922
  CDS Start-End: 84-599
ggcaaacagcccgcccggcaccaccatgctcgccctggaggctgcacagctcgacgggccacacttcagctgtctgtacccagatggcgtcttctatgacctggacagctgcaagcattccagctaccctgattcagagggggctcctgaccctggttcccccggcatatgccccgtaccccagccctgtgctatcagaggaggaagacttaccgttggacagccctgccctggaggtctcggacagcgagtcggatgaggccctcgtggctggccccgaggggaagggatccgaggcagggactcgcaagaagctgcgcctgtaccagttcctgctggggctactgacgcgcggggacatgcgtgagtgcgtgtggtgggtggagccaggcgccggcgtcttccagttctcctccaagcacaaggaactcctggcgcgccgctggggccagcagaaggggaaccgcaagcgcatgacctaccagaagctggcgcgcgccctccgaaactacgccaagaccggcgagatccgcaaggtcaagcgcaagctcacctaccagttcgacagcgcgctgctgcctgcagtccgccgggcctgagcacacccgaggctcccacctgcggagccgctgggggacctcacgtcccagccaggatccccctggaagaaaaagggcgtccccacactctaggtgataggacttacgcatccccaccttttggggtaaggggagtgctgccctgccataatccccaagcccagcccgggcctgtctgggattccccacttgtgcctggggtcctctgggatttctttgtcatgtacagactccctgggatcctcatgttttgggtgacaggacctatggaccactatactcggggaggcagggtagcagttcttccagaatcccaagagcttctctgggattttcttgtgatatctgattccccagtgaggcctgggacgtttttaagatcgctgtgtgtctgtaaaccctgaatctcatctggggtgggggccctgctggcaaccctgagccctgtccaaggttccctcttgtcagatctgagatttcctagttatgtctggggccctctgggagctgttatcatctcagatctcttcgcccatctatggctgtgttgtcacatctgtcccctcatttttgagatcccccaattctctggaactattctgctgcccctttttatgtgtctggagttccccaatcacatctagggctcctccaagatccttttgtcatgtctgaaatcactcttgagaggtctggggtggaggatggggagtcagtgaaatgtgtcatgtctgggccctgtcagggacacccttgttatatctgggatcctccaatcacatctgagacctcctaggctctccatctgatatgccctttcagggaccccacaaagactgagttctcatggggatcctacccttcctagtgccactccctatggccatgctgaagaccactctggccacgcgactgattttgggtgatcatggcagctccccacccatgtcatttctaaccagaagtctcaaggtcgtcacccccctgccccccaaccgaggccccggtcgctggtggtggtctctttagtgcactgtagcacttggtggtggaggtgtgagggatccacattaacagcaggccatcagctgggcaatggctcacacctgtaatcccagcactttgggaggcgaggcagggggaatggcttgaacccaggcattcaagaccagcctgggcaacataatgagacctcgtctctacaaaacataacaaaaacaattagccgagcgtgggggtgaacacctgtggtcccagctgctcaggaggctgaggtgggaggatctcttgagcccaggaagtaggaggctgtagtgagctgtaatcgtgccactgcactccagcctgggcgacagagtgagacaccgtcttaaaaacaaaaacaaggccgggcacggtggctcatgcctgttgtcccagcactttgggaggccgaggcaggcggatcacgaggtcgagagatcgagaccatcctggccaacatggtgaaaccctgtctctactaaaaatacagaaattagctgggcgtggtggcacgtgcctgtagtcccagctactcgggaggctgaggcaagagaatcgcttgaacgtgggaggcagaggttgcagtgagcctagattgtgccactgcactccagcctgggggacagagcgagactccgtctgaaaataaaaacaacaaaaacagcagaccattcaaaatagggagactttgcataatccagatttctgccttcacttaaaactttggacggtctggagagagtcggccagttttcggtggggggtggggagctggaacaggacagtagcctttcctaatgaggcatttgttctccaatctgccccagtcgctgccatccctggctatctcaccctagcagcttctcaagcctgttggctttagaccactgtataaacccagctggaactgaagcctgggtggactatggagccctggttgggacccccagggagtcaaaggctgcgggccaagaggccagaggtccttgagcctgggtgggcaggtggatctagggtgcatgacttgctgcttcccaaccttagtttgtcccttctgtgaaaaagggagagaaggaggaggaagatctcaaaaagactttccagcccagtgcggtggctcacgcctgtaatcccagcactttgggaggccgatgcaggtggatcacctgaggtaggagttcaagaccagcctgaccaacatagtgaagccccttctctactaaaaatacaaaattagctgggcgtggtggcatgtgcctgtactcccagctacttgggaggctgaggcaggagaatcgcttgaacctgggaggcggaggttgtagtgagctgagatcacaccactgcacaccagcctgggcgacaagagcgaaactccgtctcaaaaaaaaaaaactgttgcagccccgttgagcctttgacaccgcctgaaatccaccccactcccaggaggaggaggaggaaggaatgccaatgacctagagacacgagaagtccatgtggaggcacacagcagctgatggcagagcccaggctgggacctgcccttaagagaatgagtgggaagggggagggaggaagggcaggtaaaacgtcctccccagggccccctgcaacggggaaggtactttttacaaaagctatcattgtcaccctaaatgtggaataaaataagatgcatcgacgtag

SEQ ID NO: 185936 - DNA, 564 bp, Homo sapiens
  Payload ID: 16613
  Gene Symbol: SPIB
  Gene Name: Spi-B transcription factor (Spi-1/PU.1 related)
  ENST ID: ENST00000597855
  CDS Start-End: 23-436
aaacagcccgcccggcaccaccatgctcgccctggaggctgcacagctcgacgggccacacttcagctgtctgtacccagatggcgtcttctatgacctggacagctgcaagcattccagctaccctgattcagagggggctcctgactccctgtgggactggactgtggccccacctgtcccagccaccccctatgaagccttcgacccggcagcagccgcttttagccacccccaggctgcccagctctgctacgaaccccccacctacagccctgcagggaacctcgaactggcccccagcctggaggccccggggcctggcctccctgcataccccacggagaacttcgctagccagccctgtgctatcagaggaggaagacttaccgttggacagccctgccctggaggtctcggacagcgagtcggatgaggccctcgtggctggccccgaggggaagggatccgaggcagggactcgcaagaagctgcgcctgtaccagttcctgctggggctactgacgcgcggggacatgcgtgagtgcgtgtggtgggtggagc

SEQ ID NO: 185937 - DNA, 847 bp, Homo sapiens
  Payload ID: 16613
  Gene Symbol: SPIB
  Gene Name: Spi-B transcription factor (Spi-1/PU.1 related)
  ENST ID: ENST00000596074
  CDS Start-End: 23-256
aaacagcccgcccggcaccaccatgctcgccctggaggctgcacagctcgacgggccacacttcagctgtctgtacccagatggcgtcttctatgacctggacagctgcaagcattccagctaccctgattcagagggggctcctgaccctggttcccccggcatatgccccgtaccccagccctgtgctatcagaggaggaagacttaccgttggacagccctgccctggaggtctcggacagcgagtcggatgaggccctcgtggctggccccgaggggaagggatccgaggcagggactcgcaagaagctgcgcctgtaccagttcctgctggggctactgacgcgcggggacatgcgtgagtgcgtgtggtgggtggagccaggcgccggcgtcttccagttctcctccaagcacaaggaactcctggcgcgccgctggggccagcagaaggggaaccgcaagcgcatgacctaccagaagctggcgcgcgccctccgaaactacgccaagaccggcgagatccgcaaggtcaagcgcaagctcacctaccagttcgacagcgcgctgctgcctgcagtccgccgggcctgagcacacccgaggctcccacctgcggagccgctgggggacctcacgtcccagccaggatccccctggaagaaaaagggcgtccccacactctaggtgataggacttacgcatccccaccttttggggtaaggggagtgctgccctgccataatccccaagcccagcccgggcctgtctgggattccccacttgtgcctggggtcctctgggatttctttgtcatgtacagactccctgggatcctcatgttt

SEQ ID NO: 185938 - DNA, 3791 bp, Homo sapiens
  Payload ID: 16613
  Gene Symbol: SPIB
  Gene Name: Spi-B transcription factor (Spi-1/PU.1 related)
  Uniprot ID: Q01892
  ENST ID: ENST00000595883
  CDS Start-End: 26-814
ggcaaacagcccgcccggcaccaccatgctcgccctggaggctgcacagctcgacgggccacacttcagctgtctgtacccagatggcgtcttctatgacctggacagctgcaagcattccagctaccctgattcagagggggctcctgactccctgtgggactggactgtggccccacctgtcccagccaccccctatgaagccttcgacccggcagcagccgcttttagccacccccaggctgcccagctctgctacgaaccccccacctacagccctgcagggaacctcgaactggcccccagcctggaggccccggggcctggcctccctgcataccccacggagaacttcgctagccagaccctggttcccccggcatatgccccgtaccccagccctgtgctatcagaggaggaagacttaccgttggacagccctgccctggaggtctcggacagcgagtcggatgaggccctcgtggctggccccgaggggaagggatccgaggcagggactcgcaagaagctgcgcctgtaccagttcctgctggggctactgacgcgcggggacatgcgtgagtgcgtgtggtgggtggagccaggcgccggcgtcttccagttctcctccaagcacaaggaactcctggcgcgccgctggggccagcagaaggggaaccgcaagcgcatgacctaccagaagctggcgcgcgccctccgaaactacgccaagaccggcgagatccgcaaggtcaagcgcaagctcacctaccagttcgacagcgcgctgctgcctgcagtccgccgggcctgagcacacccgaggctcccacctgcggagccgctgggggacctcacgtcccagccaggatccccctggaagaaaaagggcgtccccacactctaggtgataggacttacgcatccccaccttttggggtaaggggagtgctgccctgccataatccccaagcccagcccgggcctgtctgggattccccacttgtgcctggggtcctctgggatttctttgtcatgtacagactccctgggatcctcatgttttgggtgacaggacctatggaccactatactcggggaggcagggtagcagttcttccagaatcccaagagcttctctgggattttcttgtgatatctgattccccagtgaggcctgggacgtttttaagatcgctgtgtgtctgtaaaccctgaatctcatctggggtgggggccctgctggcaaccctgagccctgtccaaggttccctcttgtcagatctgagatttcctagttatgtctggggccctctgggagctgttatcatctcagatctcttcgcccatctatggctgtgttgtcacatctgtcccctcatttttgagatcccccaattctctggaactattctgctgcccctttttatgtgtctggagttccccaatcacatctagggctcctccaagatccttttgtcatgtctgaaatcactcttgagaggtctggggtggaggatggggagtcagtgaaatgtgtcatgtctgggccctgtcagggacacccttgttatatctgggatcctccaatcacatctgagacctcctaggctctccatctgatatgccctttcagggaccccacaaagactgagttctcatggggatcctacccttcctagtgccactccctatggccatgctgaagaccactctggccacgcgactgattttgggtgatcatggcagctccccacccatgtcatttctaaccagaagtctcaaggtcgtcacccccctgccccccaaccgaggccccggtcgctggtggtggtctctttagtgcactgtagcacttggtggtggaggtgtgagggatccacattaacagcaggccatcagctgggcaatggctcacacctgtaatcccagcactttgggaggcgaggcagggggaatggcttgaacccaggcattcaagaccagcctgggcaacataatgagacctcgtctctacaaaacataacaaaaacaattagccgagcgtgggggtgaacacctgtggtcccagctgctcaggaggctgaggtgggaggatctcttgagcccaggaagtaggaggctgtagtgagctgtaatcgtgccactgcactccagcctgggcgacagagtgagacaccgtcttaaaaacaaaaacaaggccgggcacggtggctcatgcctgttgtcccagcactttgggaggccgaggcaggcggatcacgaggtcgagagatcgagaccatcctggccaacatggtgaaaccctgtctctactaaaaatacagaaattagctgggcgtggtggcacgtgcctgtagtcccagctactcgggaggctgaggcaagagaatcgcttgaacgtgggaggcagaggttgcagtgagcctagattgtgccactgcactccagcctgggggacagagcgagactccgtctgaaaataaaaacaacaaaaacagcagaccattcaaaatagggagactttgcataatccagatttctgccttcacttaaaactttggacggtctggagagagtcggccagttttcggtggggggtggggagctggaacaggacagtagcctttcctaatgaggcatttgttctccaatctgccccagtcgctgccatccctggctatctcaccctagcagcttctcaagcctgttggctttagaccactgtataaacccagctggaactgaagcctgggtggactatggagccctggttgggacccccagggagtcaaaggctgcgggccaagaggccagaggtccttgagcctgggtgggcaggtggatctagggtgcatgacttgctgcttcccaaccttagtttgtcccttctgtgaaaaagggagagaaggaggaggaagatctcaaaaagactttccagcccagtgcggtggctcacgcctgtaatcccagcactttgggaggccgatgcaggtggatcacctgaggtaggagttcaagaccagcctgaccaacatagtgaagccccttctctactaaaaatacaaaattagctgggcgtggtggcatgtgcctgtactcccagctacttgggaggctgaggcaggagaatcgcttgaacctgggaggcggaggttgtagtgagctgagatcacaccactgcacaccagcctgggcgacaagagcgaaactccgtctcaaaaaaaaaaaactgttgcagccccgttgagcctttgacaccgcctgaaatccaccccactcccaggaggaggaggaggaaggaatgccaatgacctagagacacgagaagtccatgtggaggcacacagcagctgatggcagagcccaggctgggacctgcccttaagagaatgagtgggaagggggagggaggaagggcaggtaaaacgtcctccccagggccccctgcaacggggaaggtactttttacaaaagctatcattgtcaccctaaatgtggaataaaataagatgcatcgacgtagacaaacctcctgggaccttttgtcagggactgcaatcctgcccctccactgaggccgctggctctcagagacaccgtgacatcacgggtgatgatgagaggagttcaaagagagaattatatgctggcgcggtggctctgtaatcccaacactttggggggccaaggcaggaggatcgcttgagtacaggagtttgaaaccagcctgggcaagatagtgagatccccttcccacccgtctacaaaaaaaataaaaaattagcggg

SEQ ID NO: 185939 - DNA, 391 bp, Homo sapiens
  Payload ID: 16613
  Gene Symbol: SPIB
  Gene Name: Spi-B transcription factor (Spi-1/PU.1 related)
  ENST ID: ENST00000594685
  CDS Start-End: 10-391
ggcaccaccatgctcgccctggaggctgcacaattcaggtggctggaggcagcctcagcatgcccctgtgtctctccccctccaggctcgacgggccacacttcagctgtctgtacccagatggcgtcttctatgacctggacagctgcaagcattccagctaccctgattcagagggggctcctgactccctgtgggactggactgtggccccacctgtcccagccaccccctatgaagccttcgacccggcagcagccgcttttagccacccccaggctgcccagctctgctacgaaccccccacctacagccctgcagggaacctcgaactggcccccagcctggaggccccggggcctggcctccctgcataccccacggagaactt

SEQ ID NO: 185940 - DNA, 1132 bp, Homo sapiens
  Payload ID: 16614
  Gene Symbol: SPIC
  Gene Name: Spi-C transcription factor (Spi-1/PU.1 related)
  Uniprot ID: Q8N5J4
  ENST ID: ENST00000551346
  CDS Start-End: 160-906
ttattttcatgatagcctaccgttgaatttaccgttctgatattaatgaaacatctctataaagggttgaagtgtcttcccggattgtcaacttattttattttattttcttcaagcaacaattgctaaggaacagaattgtcaatttattaatgaaatatgacgtgtgttgaacaagacaagctgggtcaagcatttgaagatgcttttgaggttctgaggcaacattcaactggagatcttcagtactcgccagattacagaaattacctggctttaatcaaccatcgtcctcatgtcaaaggaaattccagctgctatggagtgttgcctacagaggagcctgtctataattggagaacggtaattaacagtgctgcggacttctattttgaaggaaatattcatcaatctctgcagaacataactgaaaaccagctggtacaacccactcttctccagcaaaaggggggaaaaggcaggaagaagctccgactgtttgaataccttcacgaatccctgtataatccggagatggcatcttgtattcagtgggtagataaaaccaaaggcatctttcagtttgtatcaaaaaacaaagaaaaacttgccgagctttgggggaaaagaaaaggcaacaggaagaccatgacttaccagaaaatggccagggcactcagaaattacggaagaagtggggaaattaccaaaatccggaggaagctgacttaccagttcagtgaggccattctccaaagactctctccatcctatttcctggggaaagagatcttctattcacagtgtgttcaacctgatcaagaatatctcagtttaaataactggaatgcaaattataattatacatatgccaattaccatgagctaaatcaccatgattgctaaatatactttcatatttcatggtttactggcatcggaaatctctacaagttttaatgatttctccctccctctctttttttcctcctctgaagaaatttaggatttttctcttaaagcaaatactaaagaggaaaaaaaattaactttattgttgcttttatcaaagagtatgtaatctatactaacttgttgggaaattctgccaatgaacaacttttttataata

SEQ ID NO: 185941 - DNA, 5417 bp, Homo sapiens
  Payload ID: 16615
  Gene Symbol: SPICE1
  Gene Name: spindle and centriole associated protein 1
  Uniprot ID: Q8N0Z3
  ENST ID: ENST00000295872
  CDS Start-End: 261-2828
aacctgtggcgcgctccgcggttccggcgcctgaagttttagctgcggtggcggcggcagtcgggaccgactgcaaggcaggttgagatgatggatctgaggcttgcagctcgcagtcccaacgagccttagggaccagggctaccaaaagggtggggagaacggtggtggcatctgtctgttgcctgggatccaggcgcccggttggggaatccttacttcaggaagcgcagccgcggctctgtgttttgagagtgcaaatgtcatttgtcagagtgaaccgctgtggtccccgagttggtgtaagaaagacaccgaaagtaaagaagaagaaaacttcagtgaaacaagaatgggataataccgtgactgatctaaccgttcatcgggcaactcccgaagatctggtacgccgtcatgaaatacacaaatcgaagaatagagcattagtacactgggaactccaagaaaaagctttgaagagaaaatggaggaagcagaaaccagaaactttaaatcttgagaaaagaagattgtctatcatgaaggagattctttctgatcaataccagatgcaagatgtgttggagaaatctgatcatctaatagctgcagcaaaagagctgtttcctcgtaggcgcacagggtttccaaatgtaacagtggctcctgattcctctcagggtcccattgtggtaaatcaagaccctatcacccaatctatctttaatgagtctgtcatagaacctcaggctcttaatgatgtagatggtgaagaagaaggaactgttaatagccagtcaggagaaagtgagaatgagaatgagttggataactctctaaactctcagtctaacacgaatacagacaggtttctccaacaactaacagaagagaattttgagttaattagtaagttgtggactgacattcagcagaaaatagcaacccagtcacaaataactcctccaggaacgccatcatctgctctttcatcaggggagcaaagagctgctctgaatgctaccaatgctgtcaagagactccaaaccaggcttcagcctgaagaatctactgagactctagactcaagctacgttgtgggacacgtgctgaactcaaggaagcaaaaacagctgttaaataaagtgaaaaggaaaccgaatttgcatgctctttccaagccgaagaaaaacatatcatcaggtagcacaacctctgcagacttaccaaataggactaattccaacctggatgtcctcaaacacatgatacatgaagtggaacatgaaatggaagaatatgagcggtggacaggtcgcgaggtcaagggtctgcagagcagtcagggtcttacaggcttcactttgtcgctggtgagctccctctgtcgcctggttcggtaccttaaagagagtgagatccagctacgtaaagaagtagagacaaggcaacaactggaacaagtattaggtgatcatcgagagctcattgatgctctgacagctgaaattcttcgtcttagagaagaaaacgctgctacacaggcaagacttcagcagtacatggtcacaacagatgagcaactgatatcactcacacatgctattaagaactgtcctgtgataaataacagacaagaaattcaggcatcagaaagcggagccacaggtagaagagttatggacagtccagagcgtccagttgtaaatgccaatgtctcagtgccattgatgttcagagaggaagtggctgaattcccacaggaagagttgcccgttaaactgtctcaggtgccagaccctccagataacatgaatctggccaagaattttccagcacatatttttgagccagctgtgttgttaacaccacccaggcagaagagcaacttaaaattctctcctcttcaggacgtattgagaaggactgttcaaactcgtcctgctccacgacttcctccaactgtggaaataattgagaaggaacaaaattgggaagagaagaccttacctattgatacagacattcagaattcaagtgaagagaatcgtctcttcactcagagatggagagtctctcacatgggagaagatttggagaacaaaactcaggctccttttgttaacctctcacagcccctctgcaattcccattccaacactcaacagtcaagaagccccacattctcagaagagctcccagtactgggagatgggcagcagctgagaacaaatgagtcattaatacaaagaaaggacataatgacacgaattgctgatttgacattgcagaattcagctatcaaggcacatatgaataatattattgagcccagaggagagcaaggggatggactccgggagttgaacaaacaagaaagtgcaagtgacatgacttctacttttccagtagcacagtctctaacaccaggtagtatggaggaacggattgcagaattgaatcgacaaagtatggaggctcgtggaaaactactgcagttgatagagcagcagaaacttgttggtttgaatctttctccaccaatgtcacctgttcagttacctctcagagcatggactgaaggagcaaagaggacaattgaggtatctattccaggagcagaagccccagaaagctcaaaatgtagtactgtctctcccgtcagcgggataaatacaagaagatcttccggggctactggtaattcttgttctccactaaatgccacctcaggaagtgggagattcacacctcttaatccaagagcaaagattgagaaacagaatgaagaaggctggtttgctctttctacccatgtatcataagtgaagtcaagtctcactgagtttgttcttaataatttattacttccctttccctgctctgacttttaagtttttatatccttctttcagataaaacctacaaagatcctgtgaattagtactaatgaaacagagaaataaagcaattattttttgactttctcaaataagttttcaacaaccaactgacctacagctccctgtgaatgaaactttgactgtagagaagttaaagttttgtattttaatactttcttaagtattttaagggttttttttattaatacatttttacctttatctttattcagggttttttgaggtttagtatatcttagttgatccatttatttatttattttcctgaagaactaatttgctttgcatgtaacttacaataaaattcctctgtgtgattagagtctggctttcaggaatatgtaacacccacttttctttcttttttcttgggaagtcattgctgttcatcactttttccatcaagtgaaatatacagccttaaaaacaataggcctgggagtgtttgtttatatttgcttaagcaggtaagagtggttgcatttattataaaatcttatgtagtttttaaatgtgaaaatgtcatcaataatggtaatgcaaatcaaataaatatgattctagagctcaaatgcctaaatgtggtaacattgatttaatggtatatttaatgcttcaaacaattaaatagaaaaagttgctattaattttcccagccctgaatttaagcagatctttcagggtagatttctcttttttttttttttttgagacagagtcttgctttattgcccaggctggagtgcagttgtataatctggttcactgccacctcagtctcctgggttcaagcaatcctcttacctcagcctcctgagtagctaggattataggttcatgccaccacgcccagctaatttgtgtattttcagtagagacggggtttcaccatgttggccaggctgatctcgaactcctgacctcaaatgatccacctgccttggtttcccaaagtgccgggattacaggtgtgagccactgcacccggctcaggatagatttttcagggtacccttttggttctgagatgtttatttctattttaaacttgttttttgaatgatctctgctccctggctctatgataggaattctcaacctgagtgaacaattcaaactgagattacttgtgtttagactcatatattttgataacatatgacttctccagtatgccccagaaagctgctaataacttgctcaacctgaaatttacagttttccaaattacaggttggcagagatactggattgataacaacatccacagttatcatataatcattcttatgctgtaaacaaaattattttggttagcagaatttaataattaactgttaactacatactaggcaatattgtagccactttatgtgcttcatgacaccttatgggataggtactattatcctcattttgcagatgaggaaactgaggtacaaggaggtattttctcaaggtcacacaactagggagtggtggcattagaatgggaacataggcagtctttctccaaagcctatgctgtgctgcctcttgttggagagtaaacctgttttacagtgtgtgtagtatggaagcagcataataataagaatagctgttccttattgagccattactgtggcagacaccgtactataagctgtggtatcaccattatctcatttgaatctcatagtagacctatcagttagaggtatgtaaatgcttcctcctctcccagcacctttacagatgaggatgctgagccctagaggtgaagaaagttgtctaatgacagagtgcttgtaagaggtaaagccaagacttgaagctctttcttgcagttactggatttctcctaatttacgggaactaatacagtacagtagctaaggatgcaagtactgaaaccagaaatcttgcctcaaatgccatttctgccacttgagctgtgtactttggacaaattaatctaatctttcccatttgaaagtcagacataatgtcttccctagaggcttgtgaggattaagtgaggcaagtgtatgtaaatgggctgagatcagagcttggctcacaacactcagtaatgatcactgccaattttttttggtatataaataaataaatacactatttcccccatgtttccaatttttaagacattgtatagtgaatttattgtatctttctcagattaacaattgcacacagtgcttgaaatttagaggtatttcacctgaaaagatgtctagagattgaaagaaaacatgctgggcatatgatttgaaaatataaataacatgctatttaaaaataagtttaccctatgttttctatcttttctggcacctagatataccatttaataagtaatagcaaggataatcatttttttaagccctggaaaatcttgattaaagaggacatttcagtattgcaaataaatgcatggtatttgtgtaacattgtggaaactaataaacacaaattgtattatagcaa

SEQ ID NO: 185942 - DNA, 556 bp, Homo sapiens
  Payload ID: 16615
  Gene Symbol: SPICE1
  Gene Name: spindle and centriole associated protein 1
  ENST ID: ENST00000496859
  CDS Start-End: 500-556
gagagtgcaagtacgtgtcagggtgcgtgtctgggtatgtttgtgcgtggcgccagagcacctcgagtatgcgcgtgcgcaccgctttcgggagcttttgcacagagctggtaattgggggtgctcgattgtagcgttgggggagttcaccgtgtagcaggagagaggcaaactatccagggtgctttgggaccgggagcgtcatttaaatcgatggatgtcagaggggcttctcagaaggctcctcctgtgagttttgaggagtccgtggaagttaacccagtagagaagagagtgagcctaatgagtgttccaagcagagggaaaagaatggttgcaactgtgtgtgaggcgagagcttggttttaggatttgcgggagatgtgagagaacactggaaagaaaagtcagccgggccatatgggggagagggtctgaatgccaagctgagttggattgcttttgacagtggggagccatccgaatctagaggaagtagatgtcatttgtcagagtgaaccgctgtggtccccgagttggtgtaagaaagacaccg

SEQ ID NO: 185943 - DNA, 568 bp, Homo sapiens
  Payload ID: 16615
  Gene Symbol: SPICE1
  Gene Name: spindle and centriole associated protein 1
  ENST ID: ENST00000495812
  CDS Start-End: 49-568
tcgagtatgcgcgtgcgcaccgctttcgggagcttttgcacagagctgatgtcatttgtcagagtgaaccgctgtggtccccgagttggtgtaagaaagacaccgaaagtaaagaagaagaaaacttcagtgaaacaagaatgggataataccgtgactgatctaaccgttcatcgggcaactcccgaagatctggtacgccgtcatgaaatacacaaatcgaagaatagagcattagtacactgggaactccaagaaaaagctttgaagagaaaatggaggaagcagaaaccagaaactttaaatcttgagaaaagaagattgtctatcatgaaggagattctttctgatcaataccagatgcaagatgtgttggagaaatctgatcatctaatagctgcagcaaaagagctgtttcctcgtaggcgcacagggtttccaaatgtaacagtggctcctgattcctctcagggtcccattgtggtaaatcaagaccctatcacccaatctatctttaatgagtctgtcatagaacctcaggctcttaatgatgtagatggtgaagaag

SEQ ID NO: 185944 - DNA, 590 bp, Homo sapiens
  Payload ID: 16615
  Gene Symbol: SPICE1
  Gene Name: spindle and centriole associated protein 1
  ENST ID: ENST00000480527
  CDS Start-End: 109-590
aggcaacagcccggaagccgctggctgggttaacctgtggcgcgctccgcggttccggcgcctgaagttttagctgcggtggcggcggcagtcgggaccgactgcaagatgtcatttgtcagagtgaaccgctgtggtccccgagttggtgtaagaaagacaccgaaagtaaagaagaagaaaacttcagtgaaacaagaatgggataataccgtgactgatctaaccgttcatcgggcaactcccgaagatctggtacgccgtcatgaaatacacaaatcgaagaatagagcattagtacactgggaactccaagaaaaagctttgaagagaaaatggaggaagcagaaaccagaaactttaaatcttgagaaaagaagattgtctatcatgaaggagattctttctgatcaataccagatgcaagatgtgttggagaaatctgatcatctaatagctgcagcaaaagagctgtttcctcgtaggcgcacagggtttccaaatgtaacagtggctcctgattcctctcagggtcccattgtggtaaatcaagaccctatcacccaatctatctttaatgagtctgtcat

SEQ ID NO: 185945 - DNA, 622 bp, Homo sapiens
  Payload ID: 16615
  Gene Symbol: SPICE1
  Gene Name: spindle and centriole associated protein 1
  ENST ID: ENST00000467618
  CDS Start-End: 1-569
agttggataactctctaaactctcagtctaacacgaatacagacaggtttctccaacaactaacagaagagaattttgagttaattagtaagttgtggactgacattcagcagaaaatagcaacccagtcacaaataactcctccaggaacgccatcatctgctctttcatcaggggagcaaagagctgctctgaatgctaccaatgctgtcaagagactccaaaccaggcttcagcctgaagaatctactgagactctagactcaagctacgttgtgggacacgtgctgaactcaaggaagcaaaaacagctgttaaataaagaaggagcaaagaggacaattgaggtatctattccaggagcagaagccccagaaagctcaaaatgtagtactgtctctcccgtcagcgggataaatacaagaagatcttccggggctactggtaattcttgttctccactaaatgccacctcaggaagtgggagattcacacctcttaatccaagagcaaagattgagaaacagaatgaagaaggctggtttgctctttctacccatgtatcataagtgaagtcaagtctcactgagtttgttcttaataatttattacttccctttcc

SEQ ID NO: 185946 - DNA, 2905 bp, Homo sapiens
  Payload ID: 16616
  Gene Symbol: SKA1
  Gene Name: spindle and kinetochore associated complex subunit 1
  Uniprot ID: Q96BD8
  ENST ID: ENST00000285116
  CDS Start-End: 212-979
gatgacgcaaaccgggaacagcggctgagcctgcgcttcggaagcatggatgtgcgcctgcgctgcgctagggcgcggcgggcggtttgaattttgcttacagagtcccgtctcaccatcctgggcttccaacggagactgcggtatccgcagctggagacccagcggcgagtagccttttgctcccggacggacttgagaggcttaaaggatggcctcgtcagatctggaacaattatgctctcatgttaatgaaaagattggcaatattaagaaaaccttatcattaagaaactgtggccaggaacctaccttgaaaactgtattaaataaaataggagatgagatcattgtaataaatgaacttctaaataaattggaattggaaattcagtatcaagaacaaaccaacaattcactcaaggaactctgtgaatctcttgaagaagattacaaagacatagaacatcttaaagaaaacgttccttcccatttgcctcaagtaacagtaacccagagctgtgttaagggatcagatcttgatcctgaagaaccaatcaaagttgaagaacctgaacccgtaaagaagcctcccaaagagcaaagaagtattaaggaaatgccatttataacttgtgatgagttcaatggtgttccttcgtacatgaaatcccgcttaacctataatcaaattaatgatgttattaaagaaatcaacaaggcagtaattagtaaatataaaatcctacatcagccaaaaaagtctatgaattctgtgaccagaaatctctatcacagatttattgatgaagaaacgaaggataccaaaggtcgttattttatagtggaagctgacataaaggagttcacaactttgaaagctgacaagaagtttcacgtgttactgaatattttacgacactgccggaggctatcagaggtccgagggggaggacttactcgttatgttataacctgagtcccttgtgaacttttgaacataccaacagggtatagagtatagaggctatttctataattttcttatatataatttttttaacttttaatcttttttgtttccttttttttttttttgagacaggatcttgctttgtcacccaggggcttgctttgtcacgcaggctagagtgcagtggcgcaaacatggctcactgcagcctcaacctcccaggctcaagtgatcctcccacctcagccccctgaatggctgggactacaagcgtgcgccaccatgcctggctaatttttgtattttttggagagatggggtttcaccatgttgcctaggctggtcttgagctcctgagctcaaacaatccaccctcctcagcctcccaaagtgctgggattacaggcttgagccaccacacctgacctattcttgtttcttataaaaataaaacttttttggataaagcttatttcttgtttttttctttttctttttttttttttttgagacagtctcgctctttcacccaggccggactgcagcggcgctatctcggctcactgcaaactctgcctcccaggttcacgccatcctcctgcctcagcctcctgagtagctgggactacaggcacctgccaccacgcccagctaattttttgtatttttagtagagatggggtttcaccgtgttagccaggatggtctcgatctcctgacctcatgatccgcccacctcggcctcccaaagtgctgggattacaggcgtgagccaccgcgcccggccaacttatatattttcaagattcacctcctctcaccaaatatttaactacctgctgaatacgcctctgtactaggcacataatggaactaaaaaatgctcatgtccagtttttgtgttgagtgaacaatgctgcagaccctaataagattgggtacagatcggcatgcgcctgtagtcccagctactcaggagaattgcttgaacctaggaggtggaggttgcagtgagccgagatcgtgccactgcactccagtctgggcaacagagcgagactccatctcagaaaaaaagaaaaaaagactgggtacagatgtgatattggaagaaaaagatcaagctgatgaggttaggatacccaggccctttggacttaaagatcactagtgtctaaattccatcgatggcatttcagtctataggtaaacttcctggaagctggatttggagacagtttatcatctgattattgggctttcgtataggtccttagggagcagcttacctgaaatgcatttagtgtacaccagtctgtaaacttcaacctgtaatgaaagtgtaataaatgtacattgagttgatgtgataatgtgatataataagaaatatatatttgatcttcctatctagttccttgttcagagctcctaaaacccttgtaatttccaaagtgatggagtacatcttttgttctagtatttggtctttgaccccagttcctgacacaaagctcctaaattcctttaaatttcccagtgataggagaattttttgttctaatgaggtcactcttgatgggcacctggataactcaggatgggggctgctcacaaagaccacatcatgattggaagtttcaaactttcagtctcccacctccagagaggggagaggggctggagatttgtgtcaataatccatcaggcctatgtcaacaagacataatccgttaactatggagttcagggagcttcagggttggcaaacattttgatgtgccaggaaggtgacgcactccagctttatgaagtcagcaagtcctgtgctcaggatgcttctggaccttgccccaggtaccccttcatgtggctgttgttcatctgtatcctttgtagtagccttaaaataaactgttaaacacaagtaaa

SEQ ID NO: 185947 - DNA, 979 bp, Homo sapiens
  Payload ID: 16616
  Gene Symbol: SKA1
  Gene Name: spindle and kinetochore associated complex subunit 1
  Uniprot ID: Q96BD8
  ENST ID: ENST00000398452
  CDS Start-End: 212-979
atggatgtgcgcctgcgctgcgctagggcgcggcgggcggtttgaattttgcttacagagtcccgtctcaccatcctgggcttccaacggagactgcggtatccgcagctggagacccagcggcgagtagccttttgctcccggacggacttgaggttggagtctgtgtgttggggaccctgcctttggaagcgcccgagaggcttaaaggatggcctcgtcagatctggaacaattatgctctcatgttaatgaaaagattggcaatattaagaaaaccttatcattaagaaactgtggccaggaacctaccttgaaaactgtattaaataaaataggagatgagatcattgtaataaatgaacttctaaataaattggaattggaaattcagtatcaagaacaaaccaacaattcactcaaggaactctgtgaatctcttgaagaagattacaaagacatagaacatcttaaagaaaacgttccttcccatttgcctcaagtaacagtaacccagagctgtgttaagggatcagatcttgatcctgaagaaccaatcaaagttgaagaacctgaacccgtaaagaagcctcccaaagagcaaagaagtattaaggaaatgccatttataacttgtgatgagttcaatggtgttccttcgtacatgaaatcccgcttaacctataatcaaattaatgatgttattaaagaaatcaacaaggcagtaattagtaaatataaaatcctacatcagccaaaaaagtctatgaattctgtgaccagaaatctctatcacagatttattgatgaagaaacgaaggataccaaaggtcgttattttatagtggaagctgacataaaggagttcacaactttgaaagctgacaagaagtttcacgtgttactgaatattttacgacactgccggaggctatcagaggtccgagggggaggacttactcgttatgttataacctga

SEQ ID NO: 185948 - DNA, 1095 bp, Homo sapiens
  Payload ID: 16616
  Gene Symbol: SKA1
  Gene Name: spindle and kinetochore associated complex subunit 1
  Uniprot ID: Q96BD8
  ENST ID: ENST00000417656
  CDS Start-End: 164-793
gatgtgcgcctgcgctgcgctagggcgcggcgggcggtttgaattttgcttacagagtcccgtctcaccatcctgggcttccaacggagactgcggtatccgcagctggagacccagcggcgagtagccttttgctcccggacggacttgagaggcttaaaggatggcctcgtcagatctggaacaattatgctctcatgttaatgaaaagattggcaatattaagaaaaccttatcattaagaaactgtggccaggaacctaccttgaaaactgtattaaataaaataggagatgagatcattgtaataaatgaacttctaaataaattggaattggaaattcagtatcaagaacaaaccaacaattcactcaaggaactctgtgaatctcttgaagaagattacaaagacatagaacatcttaaagaaaacgttccttcccatttgcctcaagtaacagtaacccagagctggtacatgaaatcccgcttaacctataatcaaattaatgatgttattaaagaaatcaacaaggcagtaattagtaaatataaaatcctacatcagccaaaaaagtctatgaattctgtgaccagaaatctctatcacagatttattgatgaagaaacgaaggataccaaaggtcgttattttatagtggaagctgacataaaggagttcacaactttgaaagctgacaagaagtttcacgtgttactgaatattttacgacactgccggaggctatcagaggtccgagggggaggacttactcgttatgttataacctgagtcccttgtgaacttttgaacataccaacagggtatagagtatagaggctatttctataattttcttatatataatttttttaacttttaatcttttttgtttccttttttttttttttgagacaggatcttgctttgtcacccaggggcttgctttgtcacgcaggctagagtgcagtggcgcaaacatggctcactgcagcctcaacctcccaggctcaagtgatcctcccacctcagccccctgaatggctgggactacaagcgtgcgccaccatgcctggctaatttttgtatttttt

SEQ ID NO: 185949 - DNA, 2905 bp, Homo sapiens; identical to SEQ ID NO: 185946
  Payload ID: 16616
  Gene Symbol: SKA1
  Gene Name: spindle and kinetochore associated complex subunit 1
  Uniprot ID: Q96BD8
  ENST ID: ENST00000571751
  CDS Start-End: 212-979

SEQ ID NO: 185950 - DNA, 669 bp, Homo sapiens
  Payload ID: 16616
  Gene Symbol: SKA1
  Gene Name: spindle and kinetochore associated complex subunit 1
  ENST ID: ENST00000488454
  CDS Start-End: 351-665
gtgcgcctgcgctgcgctagggcgcggcgggcggtttgaattttgcttacagagtcccgtctcaccatcctgggcttccaacggagactgcggtatccgcagctggagacccagcggcgagtagccttttgctcccggacggacttgagaggcttaaaggatggcctcgtcagatctggaacaattatgctctcatgttaatgaaaagattggcaatattaagaaaaccttatcattaagaaactgtggaactctgtgaatctcttgaagaagattacaaagacatagaacatcttaaagaaaacgttccttcccatttgcctcaagtaacagtaacccagagctggtacatgaaatcccgcttaacctataatcaaattaatgatgttattaaagaaatcaacaaggcagtaattagtaaatataaaatcctacatcagccaaaaaagtctatgaattctgtgaccagaaatctctatcacagatttattgatgaagaaacgaaggataccaaaggtcgttattttatagtggaagctgacataaaggagttcacaactttgaaagctgacaagaagtttcacgtgttactgaatattttacgacactgccggaggctatcagaggtccgagggggaggacttactcgttatgttataacctgagtcc

SEQ ID NO: 185951 - DNA, 746 bp, Homo sapiens
  Payload ID: 16616
  Gene Symbol: SKA1
  Gene Name: spindle and kinetochore associated complex subunit 1
  ENST ID: ENST00000494518
  CDS Start-End: 474-746
gctagggcgcggcgggcggtttgaattttgcttacagagtcccgtctcaccatcctgggcttccaacggagactgcggtatccgcagctggagacccagcggcgagtagccttttgctcccggacggacttgaggttggagtctgtgtgttggggaccctgcctttggaagcgcccgagaggcttaaaggatggcctcgtcagatctggaacaattatgctctcatgttaatgaaaagattggcaatattaagaaaaccttatcattaagaaactgtggaactctgtgaatctcttgaagaagattacaaagacatagaacatcttaaagaaaacgttccttcccatttgcctcaagtaacagtaacccagagctgtgttaagggatcagatcttgatcctgaagaaccaatcaaagttgaagaacctgaacccgtaaagaagcctcccaaagagcaaagaagtattaaggaaatgccatttataacttgtgatgagttcaatggtgttccttcgtacatgaaatcccgcttaacctataatcaaattaatgatgttattaaagaaatcaacaaggcagtaattagtaaatataaaatcctacatcagccaaaaaagtctatgaattctgtgaccagaaatctctatcacagatttattgatgaagaaacgaaggataccaaaggtcgttattttatagtggaagctgacataaaggagttcacaactttgaaagctgacaagaag

SEQ ID NO: 185952 - DNA, 979 bp, Homo sapiens; identical to SEQ ID NO: 185947
  Payload ID: 16616
  Gene Symbol: SKA1
  Gene Name: spindle and kinetochore associated complex subunit 1
  Uniprot ID: Q96BD8
  ENST ID: ENST00000616604
  CDS Start-End: 212-979

SEQ ID NO: 185953 - DNA, 669 bp, Homo sapiens; identical to SEQ ID NO: 185950
  Payload ID: 16616
  Gene Symbol: SKA1
  Gene Name: spindle and kinetochore associated complex subunit 1
  ENST ID: ENST00000576078
  CDS Start-End: 351-665

SEQ ID NO: 185954 - DNA, 746 bp, Homo sapiens; identical to SEQ ID NO: 185951
  Payload ID: 16616
  Gene Symbol: SKA1
  Gene Name: spindle and kinetochore associated complex subunit 1
  ENST ID: ENST00000571318
  CDS Start-End: 474-746

SEQ ID NO: 185955 - DNA, 1095 bp, Homo sapiens; identical to SEQ ID NO: 185948
  Payload ID: 16616
  Gene Symbol: SKA1
  Gene Name: spindle and kinetochore associated complex subunit 1
  Uniprot ID: Q96BD8
  ENST ID: ENST00000633940
  CDS Start-End: 164-793

SEQ ID NO: 185956 - DNA, 2798 bp, Homo sapiens
  Payload ID: 16617
  Gene Symbol: SKA2
  Gene Name: spindle and kinetochore associated complex subunit 2
  Uniprot ID: Q8WVK7
  ENST ID: ENST00000330137
  CDS Start-End: 107-472
aatgagtgcgagatgttgagtgacagctgtccaatggaggccctccgtgctagtacggcttgcggcttaagcgccgccgcggtctgcggaatgtcaactattcaacatggaggcggaggtcgataagctggaactgatgttccagaaagctgagtctgatctggattacattcaatacaggctggaatatgaaatcaagactaatcatcctgattcagcaagtgagaaaaatccagttacactcttaaaggaattgtcagtgataaagtctcgatatcaaactttgtatgcccgctttaaaccagttgctgttgagcagaaagagagtaagagccgcatttgtgctactgtgaaaaagactatgaatatgatacaaaaactacagaagcaaacagacctggagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgtggctttgtaaattaaagtataggcaaaacatttgtgttatacatgatatataatttcattttgtaaatgttgattgcacatgtggtcacattattgttgagactgcttttatgtgacctgtagtctcccacagaacctaaagtaataagctggcttttctgtgatagccacgtttgcgtatttctttccctatttcccttgcctgctaatgttgaacagcatgaacttgctttctgatgctgttttagactgtccctgttgtatctcaataatatctttgttttccttcagcctttattactataattgttcattctacatgaaagctaggaaactgaaattagaagagcacttatctgctacttgccagttttgcgtgagtgtgttatatgtatgtgtcaatttccctttaaaataactatttattttaaaataactattggcaataaggaaactgttcaaagtagaggcagatcttgatagaaagatgttaatcacagggttgtttataatagcaatatacatacacatttggctagtactaggtgaataggaaaataaatcatgctgtatgtatacaataagaggtcaagttgccaataaattattactgttaatgttctgggaaatgctgaaactatgctaagtgggggagagggaaagcaggtattgcagttttgtagtgaagattgggctttggagtcatatctgagatgtaagtagcagcttttaaattctagctatgaccctgtgcagatcacttaacttttgagtgtcaggatgtttggaaggacaagacaggaaagtgttttaatacagggttcagtatttagtaagccttcaataagtgatattacatacatgtaataaaaactaagcattgaaaggactaggaaaaatgcatcaaatgttagttctgcaggttatagaattatacttttatgtaattttaaaatttcagttatgaacatgtttgtccattaacaaacttataatagctgaaaaacagggttgtgagaacagcttcagttaaaattgtcctgtctagtttgaatatttcaagaacagaaagcctttttttttttttttttttttttgagacggagtctcactctgttgcccaggctggaatgcagtggtacgctctcagctcactgcaacctccacctcccaggttcaagcagttctctgccccaccctcccgagtagctgggattacaggcgcccgccaccacgcccggctatttttttgtatttttagtagagatggggcttcaccatcttgaccaggctggtctttaactcctgatggtgatccacccacctcggcctcccaaagtgctgggattacaggcatgagctaccgtgcctggcccccttttttttaattacagagaaataagttacaccttagtatcagatattaattttcttcagtgttcaggcaattagtatttagaaagctcttgtcatgagatggctctgggatgtgatgatgattgttgggattgaaaaaacggtagtatcatggagagatcataataaattcttagtattaaaagtggttttgctttcagttagggagaaaaattagattgtactatttttcctctatgatttccttcagttatcttccaaatgttgttttttccccacagcccccttaacattgttctctatgcacttctcaatacattttcatttgtttctcaagcctctttgtggatgactcctaaatataacttcttccactagctctagatccgtatttccaataaaatcccctacctgaatattcaagttaaacatgtccagaatacttactgattttattgttaatagccactattctgttgtctggaattaaaacctgtataactaatttgcatccctttatcttcttagtcaataaaacctacaatcctctttctaaaa

SEQ ID NO: 185957 - DNA, 625 bp, Homo sapiens
  Payload ID: 16617
  Gene Symbol: SKA2
  Gene Name: spindle and kinetochore associated complex subunit 2
  Uniprot ID: Q8WVK7
  ENST ID: ENST00000437036
  CDS Start-End: 112-339
gccgcggtctgcggaatgtcaactattcaacatggaggcggaggtcgataagctggaactgatggtgagtgcaaagtgaaggagatctactgggtagtttatttttcccccatggcctcggaggtggggcacaatttggagtcgccggaaactccgggcggcggaggctggaccagagtcgagttccctcctcctgcaccaaagggagccgccaccgtctggtgtctaaaccgcctcggttccagaaagctgagtctgatctggattacattcaatacaggctggaatatgaaatcaagactaatcatcctgattcagcaagtgagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaat

SEQ ID NO: 185958 - DNA, 689 bp, Homo sapiens
  Payload ID: 16617
  Gene Symbol: SKA2
  Gene Name: spindle and kinetochore associated complex subunit 2
  ENST ID: ENST00000580541
  CDS Start-End: 102-242
gcggaatgtcaactattcaacatggaggcggaggtcgataagctggaactgatggtgagtgcaaagtgaaggagatctactgggtagtttatttttcccccatggcctcggaggtggggcacaatttggagtcgccggaaactccgggcggcggaggctggaccagagtcgagttccctcctcctgcaccaaagggagccgccaccgtctggtgtctaaaccgcctcggctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtatgt

SEQ ID NO: 185959 - DNA, 595 bp, Homo sapiens
  Payload ID: 16617
  Gene Symbol: SKA2
  Gene Name: spindle and kinetochore associated complex subunit 2
  ENST ID: ENST00000581068
  CDS Start-End: 86-274
gacagctgtccaatggaggccctccgtgctagtacggcttgcggcttaagcgccgccgcggtctgcggaatgtcaactattcaacatggaggcggaggtcgataagctggaactgatgttccagaaagctgagtctgatctggattacattcaatacaggctggaatatgaaatcaagactaatcatcctgattcagcaagtgagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaa

SEQ ID NO: 185960 - DNA, 583 bp, Homo sapiens
  Payload ID: 16617
  Gene Symbol: SKA2
  Gene Name: spindle and kinetochore associated complex subunit 2
  ENST ID: ENST00000583380
  CDS Start-End: 12-341
aactattcaacatggaggcggaggtcgataagctggaactgatgttccagaaagctgagtctgatctggattacattcaatacaggctggaatatgaaatcaagactaatcatcctgattcagcaagtgagaaaaatccagttacactcttaaaggaattgtcagtgataaagtctcgatatcaaactttgtatgcccgctttaaaccagttgctgttgagcagaaagagagtaagagccgcatttgtgctactgtgaaaaagactatgaatatgatacaaaaactacagaagcaaacagacctggaggtaatgctttcagttgacagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaat

SEQ ID NO: 185961 - DNA, 689 bp, Homo sapiens
  Payload ID: 16617
  Gene Symbol: SKA2
  Gene Name: spindle and kinetochore associated complex subunit 2
  ENST ID: ENST00000578105
  CDS Start-End: 22-300
gcggaatgtcaactattcaacatggaggcggaggtcgataagctggaactgatgaaaaatccagttacactcttaaaggaattgtcagtgataaagtctcgatatcaaactttgtatgcccgctttaaaccagttgctgttgagcagaaagagagtaagagccgcatttgtgctactgtgaaaaagactatgaatatgatacaaaaactacagaagcaaacagacctggagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggtat

SEQ ID NO: 185962 - DNA, 570 bp, Homo sapiens
  Payload ID: 16617
  Gene Symbol: SKA2
  Gene Name: spindle and kinetochore associated complex subunit 2
  ENST ID: ENST00000583976
  CDS Start-End: 95-331
gtcaactattcaacatggaggcggaggtcgataagctggaactgatggtgagtgcaaagtgaaggagatctactgggtagtttatttttcccccatggcctcggaggtggggcacaatttggagtcgccggaaactccgggcggcggaggctggaccagagtcgagttccctcctcctgcaccaaagggagccgccaccgtctggtgtctaaaccgcctcggttccagaaagctgagtctgatctggattacattcaatacaggctggaatatgaaatcaagactaatcatcctgattcagcaagtgagaaaaatccagttacactcttaaaggaattgtcagtgataaagtctcgatatcaaactttgtatgcccgctttaaaccagttgctgttgagcagaaagagagtaagagccgcatttgtgctactgtgaaaaagactatgaatatgatacaaaaactacagaagcaaacagacctggagctgtcaccactgactaaagaagagaaaactgcggcagagcaattcaaatttcacatgccagatttatgaagaaatggacttgga

SEQ ID NO: 185963 - DNA, 229 bp, Homo sapiens
  Payload ID: 16617
  Gene Symbol: SKA2
  Gene Name: spindle and kinetochore associated complex subunit 2
  ENST ID: ENST00000584089
  CDS Start-End: 31-229
cttagtaaactcaagataaaaagctgtaagatgttccagaaagctgagtctgatctggattacattcaatacaggctggaatatgaaatcaagactaatcatcctgattcagcaagtgagaaaaatccagttacactcttaaaggaattgtcagtgataaagtctcgatatcaaactttgtatgcccgctttaaaccagttgctgttgagcagaaagagagtaagagcc

SEQ ID NO: 185964 - DNA, 894 bp, Homo sapiens
  Payload ID: 16617
  Gene Symbol: SKA2
  Gene Name: spindle and kinetochore associated complex subunit 2
  ENST ID: ENST00000578519
  CDS Start-End: 20-205
ggaatgtcaactattcaacatggaggcggaggtcgataagctggaactgatgttccagaaagctgagtctgatctggattacattcaatacaggctggaatatgaaatcaagactaatcatcctgattcagcaagtgagacagagtctcactctgttgtccagactggagtgcagtggcatgatcatggctcactgcagctttgacctcctgggctcaggtgatcctcccacctcagtctcctgcgtaggtggaaatacagaaaaatccagttacactcttaaaggaattgtcagtgataaagtctcgatatcaaactttgtatgcccgctttaaaccagttgctgttgagcagaaagagagtaagagccgcatttgtgctactgtgaaaaagactatgaatatgatacaaaaactacagaagcaaacagacctggagctgtcaccactgactaaagaagagaaaactgcggcagagcaattcaaatttcacatgccagatttatgaagaaatggacttggaaaggaaattctaacagagaagagcttaattccggagaaatttaggaagatgtcttgttaacccttgatgtctagagattgggggctggtgaagggggtttggcttcaatgactggataatgatatctttcatgagagagattataagaagaagggcagataatatatgaataaagttcagccaaaaggatcaaatgagaataaaacgatttaaatatatgtacacacgcatgcacacacacacttagtcttgtaatttcaggccagaaattctcaacactattttgcatctgttttctttttctaagtcatgataatatagatgttctggtctatcataaaagaatgtttatgtacatttcagtcattcggt

SEQ ID NO: 185965 - DNA, 2803 bp, Homo sapiens
  Payload ID: 16618
  Gene Symbol: SKA3
  Gene Name: spindle and kinetochore associated complex subunit 3
  Uniprot ID: Q8IX90
  ENST ID: ENST00000298260
  CDS Start-End: 72-179
tagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaagtgaggaggccatagatacagaatccaggctcaatgataatgtttttgccactcccagccccatcatccagcagttggaaaaaagtgatgccgaatataccaactctcctttggtacctacattctgtactcctggtttgaaaattccatctacaaagaacagcatagctttggtatccacaaattacccattatcaaaaacaaatagttcatcaaatgatttggaagttgaagatcgtacttcgttggttttaaattcagacacatgctttgagaatttaacagatccctcttcacctacgatttcttcttatgagaatctgctcagaacacctacacctccggaagtaactaaaattccagaagatattctccagcttttatcaaaatacaactcaaacctagctactccaatagcaattaaagcagtgccacccagtaaaaggttccttaaacatggacagaacatccgagatgtcagcaacaaagaaaactgaaattccagtggatctatccaacacagaaactgaacaaaatgagatgaaagccgagctggaccgattttaacattcacattgccctgcctctgtccccctttaaacgttgacccattttaaagacaaacatgaacattaacatcataatatgctttttatgaagtttcaataaggtttaaccttagtcttgttgacatgtagcccagtcattcactctttaaggattattagtgtttcattgatactaaattacccagcttaatcaacagaatggtttaagtagtaccaggaagtaggacaagtaatttcaaaaatataaaggtgtttgctactcagatgaggccgcccctgaccttctggccagagagacattgctgccagccagctctgccttcccatcatctcctttcaggaccgtcccacaccttttacttgctcagtgctgtctgaagatgcagttgctgtttgcaaacaacaggaacaccagttaaactaattaggaaaagagggagatttccaggcctgggtaactatatactgtgaccattggaggtagagacaggtctcaacagttggaaccaggaactctgctgtcaggttgagagttttgtttctcttccagcttttcactgtgtgggggtcttttctcttatgtcagctctttctatcacatggcagctgacctctcacgctccactctgcagcttggacacccagtagaccctgaatttcactctctctaaaaggttctgagggctcatcctgggccaggggccctcctgtgcactgttagctatggccacgggagcctccagagctgcctggtagcttcaggttgacctgcttatcaggcctacgatccttctgatttaagtacagctggaaagtattatctaattaagttcatgatagtgcttttggagaacttgtcaaattacagccaatgagaaaataaggacctagcatactgtggagaaccattaaaaatttgagaagaaacaacaagtattatgtcaacttacttcaaaggcgtagttttgggaatttgatgcagtaaagattaccctgttttatgattgttccttgaaagtcaaatgggggacctgtccattgtgctctattaatcttgtcagaaaactgtcaccaaaacaaaacttgagtttgtccttgttctaggagttactgggtagttgtaagtattatttttattaaatataatgtaaaataaaatgttaagatacttagttttgtttttcaaagtaaagctgtagtcagccttatgtatgccattgactctgaaatgtataccagcctttcactgtgtaccgtgtgtatataaatccacagaaccggatgagctgcttagggagggaatatattcaaagtgtaccaaggaccaaatcctggagttctcccaactttagaggatggaaaggggcagagtaatctagcaaaggagactgaggccagtgaagtaggaagaaagtatttcaaggagagtgatgattctgtgaatattgctgagaattcaaataaaaagaggactgagaactga

SEQ ID NO: 185966 - DNA, 2919 bp, Homo sapiens
  Payload ID: 16618
  Gene Symbol: SKA3
  Gene Name: spindle and kinetochore associated complex subunit 3
  Uniprot ID: Q8IX90
  ENST ID: ENST00000314759
  CDS Start-End: 126-1364
gagaggactgcgcctgcgcagagccgaggacgcgtccggcgccgagattcaaactagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcgactttgaagattatccaatgagaattttatatgaccttcattcagaagttcagactctaaaggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaagtgaggaggccatagatacagaatccaggctcaatgataatgtttttgccactcccagccccatcatccagcagttggaaaaaagtgatgccgaatataccaactctcctttggtacctacattctgtactcctggtttgaaaattccatctacaaagaacagcatagctttggtatccacaaattacccattatcaaaaacaaatagttcatcaaatgatttggaagttgaagatcgtacttcgttggttttaaattcagacacatgctttgagaatttaacagatccctcttcacctacgatttcttcttatgagaatctgctcagaacacctacacctccggaagtaactaaaattccagaagatattctccagcttttatcaaaatacaactcaaacctagctactccaatagcaattaaagcagtgccacccagtaaaaggttccttaaacatggacagaacatccgagatgtcagcaacaaagaaaactgaaattccagtggatctatccaacacagaaactgaacaaaatgagatgaaagccgagctggaccgattttaacattcacattgccctgcctctgtccccctttaaacgttgacccattttaaagacaaacatgaacattaacatcataatatgctttttatgaagtttcaataaggtttaaccttagtcttgttgacatgtagcccagtcattcactctttaaggattattagtgtttcattgatactaaattacccagcttaatcaacagaatggtttaagtagtaccaggaagtaggacaagtaatttcaaaaatataaaggtgtttgctactcagatgaggccgcccctgaccttctggccagagagacattgctgccagccagctctgccttcccatcatctcctttcaggaccgtcccacaccttttacttgctcagtgctgtctgaagatgcagttgctgtttgcaaacaacaggaacaccagttaaactaattaggaaaagagggagatttccaggcctgggtaactatatactgtgaccattggaggtagagacaggtctcaacagttggaaccaggaactctgctgtcaggttgagagttttgtttctcttccagcttttcactgtgtgggggtcttttctcttatgtcagctctttctatcacatggcagctgacctctcacgctccactctgcagcttggacacccagtagaccctgaatttcactctctctaaaaggttctgagggctcatcctgggccaggggccctcctgtgcactgttagctatggccacgggagcctccagagctgcctggtagcttcaggttgacctgcttatcaggcctacgatccttctgatttaagtacagctggaaagtattatctaattaagttcatgatagtgcttttggagaacttgtcaaattacagccaatgagaaaataaggacctagcatactgtggagaaccattaaaaatttgagaagaaacaacaagtattatgtcaacttacttcaaaggcgtagttttgggaatttgatgcagtaaagattaccctgttttatgattgttccttgaaagtcaaatgggggacctgtccattgtgctctattaatcttgtcagaaaactgtcaccaaaacaaaacttgagtttgtccttgttctaggagttactgggtagttgtaagtattatttttattaaatataatgtaaaataaaatgttaagatacttagttttgtttttcaaagtaaagctgtagtcagccttatgtatgccattgactctgaaatgtataccagcctttcactgtgtaccgtgtgtatataaatccacagaaccggatgagctgcttagggagggaatatattcaaagtgtaccaaggaccaaatcctggagttctcccaactttagaggatggaaaggggcagagtaatctagcaaaggagactgaggccagtgaagtaggaagaaagtatttcaaggagagtgatgattctgtgaatattgctgagaattcaaataaaaagaggactgagaactga

SEQ ID NO: 185967 - DNA, 2745 bp, Homo sapiens
  Payload ID: 16618
  Gene Symbol: SKA3
  Gene Name: spindle and kinetochore associated complex subunit 3
  Uniprot ID: Q8IX90
  ENST ID: ENST00000400018
  CDS Start-End: 71-1237
agtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcgactttgaagattatccaatgagaattttatatgaccttcattcagaagttcagactctaaaggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaagtgaggaggccatagatacagaatccaggctcaatgataatgtttttgccactcccagccccatcatccagcagttggaaaaaagtgatgccgaatataccaactctcctttggtacctacattctgtactcctggtttgaaaattccatctacaaagaacagcatagctttggtatccacaaattacccattatcaaaaacaaatagttcatcaaatgatttggaagttgaagatcgtacttcgttggttttaaattcagacacatgctttgagaatttaacagatccctcttcacctacgatttcttcttatgagaatctgctcagaacacctacacctccggaagtaactaaaattccagaagatattctccagaaattccagtggatctatccaacacagaaactgaacaaaatgagatgaaagccgagctggaccgattttaacattcacattgccctgcctctgtccccctttaaacgttgacccattttaaagacaaacatgaacattaacatcataatatgctttttatgaagtttcaataaggtttaaccttagtcttgttgacatgtagcccagtcattcactctttaaggattattagtgtttcattgatactaaattacccagcttaatcaacagaatggtttaagtagtaccaggaagtaggacaagtaatttcaaaaatataaaggtgtttgctactcagatgaggccgcccctgaccttctggccagagagacattgctgccagccagctctgccttcccatcatctcctttcaggaccgtcccacaccttttacttgctcagtgctgtctgaagatgcagttgctgtttgcaaacaacaggaacaccagttaaactaattaggaaaagagggagatttccaggcctgggtaactatatactgtgaccattggaggtagagacaggtctcaacagttggaaccaggaactctgctgtcaggttgagagttttgtttctcttccagcttttcactgtgtgggggtcttttctcttatgtcagctctttctatcacatggcagctgacctctcacgctccactctgcagcttggacacccagtagaccctgaatttcactctctctaaaaggttctgagggctcatcctgggccaggggccctcctgtgcactgttagctatggccacgggagcctccagagctgcctggtagcttcaggttgacctgcttatcaggcctacgatccttctgatttaagtacagctggaaagtattatctaattaagttcatgatagtgcttttggagaacttgtcaaattacagccaatgagaaaataaggacctagcatactgtggagaaccattaaaaatttgagaagaaacaacaagtattatgtcaacttacttcaaaggcgtagttttgggaatttgatgcagtaaagattaccctgttttatgattgttccttgaaagtcaaatgggggacctgtccattgtgctctattaatcttgtcagaaaactgtcaccaaaacaaaacttgagtttgtccttgttctaggagttactgggtagttgtaagtattatttttattaaatataatgtaaaataaaatgttaagatacttagttttgtttttcaaagtaaagctgtagtcagccttatgtatgccattgactctgaaatgtataccagcctttcactgtgtaccgtgtgtatataaatccacagaaccggatgagctgcttagggagggaatatattcaaagtgtaccaaggaccaaatcctggagttctcccaactttagaggatggaaaggggcagagtaatctagcaaaggagactgaggccagtgaagtaggaagaaagtatttcaaggagagtgatgattctgtgaatattgctgagaattcaaataaaaagaggactgagaactga

SEQ ID NO: 185968 - DNA, 930 bp, Homo sapiens
  Payload ID: 16618
  Gene Symbol: SKA3
  Gene Name: spindle and kinetochore associated complex subunit 3
  ENST ID: ENST00000465471
  CDS Start-End: 75-185
aactagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcggtgcgtgaggcgggcggccagggcacgactttgaagattatccaatgagaattttatatgaccttcattcagaagttcagactctaaaggatgatgttaatattcttcttgataaagcaagattggaaaatcaagaaggcattgatttcataaaggcaacaaaagtactaatggaaaaaaattcaatggatattatgaaaataagagagtatttccagaagtatggatatagtccacgtgtcaagaaaaattcagtacacgagcaagaagccattaactctgacccagagttgtctaattgtgaaaattttcagaagactgatgtgaaagatgatctgtctgatcctcctgttgcaagcagttgtatttctgagaagtctccacgtagtccacaactttcagattttggacttgagcggtacatcgtatcccaagttctaccaaaccctccacaggcagtgaacaactataaggaagagcccgtaattgtaaccccacctaccaaacaatcactagtaaaagtactaaaaactccaaaatgtgcactaaaaatggatgattttgagtgtgtaactcctaaattagaacactttggtatctctgaatatactatgtgtttaaatgaagattacacaatgggacttaaaaatgcgaggaataataaaagtgaggaggccatagatacagaatccaggctcaatgataatgtttttgccactcccagccccatcatccagcagttggaaaaaagtg

SEQ ID NO: 185969 - DNA, 750 bp, Homo sapiens
  Payload ID: 16618
  Gene Symbol: SKA3
  Gene Name: spindle and kinetochore associated complex subunit 3
  ENST ID: ENST00000462482
  CDS Start-End: 75-224
aactagtggcgggaggctgtgagctgagcggtggggtctgcgtacgcctggagtccttccccgctgtgctcagcatggaccctatccggagcttctgcgggaagctgcggtctctggccagcacgctggactgcgagacggcccggctgcagcgagcgctggacggagaggaaagcgcttttatcaaaatacaactcaaacctagctactccaatagcaattaaagcagtgccacccagtaaaaggttccttaaacatggacagaacatccgagatgtcagcaacaaagaaaactgaaattccagtggatctatccaacacagaaactgaacaaaatgagatgaaagccgagctggaccgattttaacattcacattgccctgcctctgtccccctttaaacgttgacccattttaaagacaaacatgaacattaacatcataatatgctttttatgaagtttcaataaggtttaaccttagtcttgttgacatgtagcccagtcattcactctttaaggattattagtgtttcattgatactaaattacccagcttaatcaacagaatggtttaagtagtaccaggaagtaggacaagtaatttcaaaaatataaaggtgtttgctactcagatgaggccgcccctgaccttctggccagagagacattgctgccagccagctctgccttcccatcatctcctttcaggaccgtcccacaccttttacttgctcagtgctgtctgaaga

SEQ ID NO: 185970 - DNA, 2668 bp, Homo sapiens
  Payload ID: 16619
  Gene Symbol: SPDL1
  Gene Name: spindle apparatus coiled-coil protein 1
  Uniprot ID: Q96EA4
  ENST ID: ENST00000265295
  CDS Start-End: 280-2097
acatgcgcagtagctgtaggagggggtgggcgctccattgggcgtttctcttggtttttcctttccgcgcggcttgggcggacgtctcgtgagacgtgggacttctcgcgggaactgcattcaaatatcccaggcgcttactcgagagctagctgagcgaatgggccggcgactgtggagttagcgtcctcaatgtggacgccctgagctcccattaggagccgctggctgcggcagcaggggactagcgtgagagttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagttatgaacaagaaaaatatacccttcaaagagaagttgaactcaagagtcgaatgttagaaagtttgagctgcgaatgtgaagctattaaacaacaacaaaaaatgcacctggagaaattggaagaacaactaagcagaagccatggacaggaagtgaatgaactaaaaactaagatagaaaaactgaaagtggaattagatgaagccaggcttagtgaaaagcagctgaagcaccaagtagatcatcagaaggaactcctctcttgtaaatcagaggaactgcgcgtaatgtctgaacgtgtgcaggaaagcatgtcttcagagatgctggctcttcaaattgagctgacagaaatggagagtatgaagaccaccctcaaagaagaagtgaatgaactacaatacagacaagaacagctagaacttcttattactaacctaatgcgccaggtagaccggcttaaagaggaaaaagaggagcgagagaaagaagcagtttcttactataatgccctagagaaagctcgtgtagcaaatcaagatcttcaggtacagttggaccaggcactccagcaagccttggatcccaatagtaaaggcaactctttgtttgcagaggtggaagatcgaagggcagcaatggaacgtcagctcatcagtatgaaagtcaagtatcagtcactaaagaagcaaaatgtatttaacagagaacagatgcagagaatgaagttacaaattgccacgttgctacagatgaaagggtctcaaactgaatttgagcagcaggaacggttgcttgccatgttggagcagaagaatggtgaaataaaacatcttttaggtgaaattagaaatctggagaaatttaagaatttatatgacagtatggaatctaagccttcagtcgactctggtactctggaagataacacctattatacagatttacttcagatgaagctggataacttaaacaaagaaattgaaagcactaaaggtgaattgtccatacagcgaatgaaagcattatttgagagccagcgggctctagatattgagcgaaaactttttgcaaatgaaagatgcctccagctttcagaaagtgaaaatatgaaactgagagctaaactagatgaattgaaactaaaatatgaacctgaagagacagttgaagtgcctgtactgaaaaagaggcgtgaggtgctccctgtggatataaccaccgctaaagatgcatgtgtcaacaacagtgctctcgggggagaagtttatcgattaccgcctcagaaagaggagacacagtcctgccctaacagtttagaagataacaacttgcaattagaaaaatcagtttctatatacacaccagtagtcagtctctctcctcacaaaaatctgcccgtggatatgcagctgaagaaggaaaagaaatgtgtgaaactcataggagttcccgctgacgctgaggccttaagtgaaagaagtggaaacacccctaactctcccaggttagctgctgaatcaaagcttcaaacagaagttaaagaaggaaaagaaacttcaagcaaattggaaaaagaaacttgtaagaaattacaccctattctatatgtgtcttctaaatctactccagagacccagtgccctcaacagtaaagacttgtctttaataagagtacggtgccacttgcctcaaaagttactatggtgcttaagattgtcttgatctgacatatatcaccttctgggttatttactcattgtgccaggacctggcattttcatgtgcctttgaccaagtgttcagaatttgcttgactctaacctggagagcttcttaagtgatgccccttcatggagcttctatgacagtgaataaactattaattgaaggaaaatgttataattaatgtatctatttgctgcattgtatatggattaaatgataaaaaacaagtaatctaccctcagagccatgtatttgagaatgcttcaatcatattttcctatgtacttttttttataaacttagttttagactatgttgtaaaaatgggaaggttgtaaactatgttgtaaaaataggaaatgtggcttaaaatatatacattatattgtttcaggattttgtcagtgtttaaagaaccaatgttcatctttgtatttatatacatgatttaaattttgtctaaaattttaaataaaactgcagtgatttatccttaaa

SEQ ID NO: 185971 - DNA, 711 bp, Homo sapiens
  Payload ID: 16619
  Gene Symbol: SPDL1
  Gene Name: spindle apparatus coiled-coil protein 1
  ENST ID: ENST00000506574
  CDS Start-End: 452-711
atgcgcagtagctgtaggagggggtgggcgctccattgggcgtttctcttggtttttcctttccgcgcggcttgggcggacgtctcgtgagacgtgggacttctcgcgggaactgcattcaaatatcccaggcgcttactcgagagctagctgagcgaatgggccggcgactgtggagttagcgtcctcaatgtggacgccctgagctcccattaggagccgctggctgcggcagcaggggactagcgtgagagtttcatgagggaggagcttttttttcgtccattttgttccctaatgaatctgaactgcccagaatggaacctagtatataaggcattcaagaaatactcgttcagtgaatgactacattgacttgagacatgggggaacatcttgcaatgacctggtgccctttgaaggcaaagttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagttatgaacaagaaaaatatacccttcaaagagaagttgaactcaagagtcgaatgttagaaagtttgagctgcgaatgtgaagctattaaacaacaaca

SEQ ID NO: 185972 - DNA, 896 bp, Homo sapiens
  Payload ID: 16619
  Gene Symbol: SPDL1
  Gene Name: spindle apparatus coiled-coil protein 1
  ENST ID: ENST00000513941
  CDS Start-End: 206-896
tgagcgaatgggccggcgactgtggagttagcgtcctcaatgtggacgccctgagctcccattaggagccgctggctgcggcagcaggggactagcgtgagagggattctggacaaatatggaacgttgggtcggttgccgggtcctcaaaattataaccgccactggatctgcgctgtgcgttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagttatgaacaagaaaaatatacccttcaaagagaagttgaactcaagagtcgaatgttagaaagtttgagctgcgaatgtgaagctattaaacaacaacaaaaaatgcacctggagaaattggaagaacaactaagcagaagccatggacaggaagtgaatgaactaaaaactaagatagaaaaactgaaagtggaattagatgaagccaggcttagtgaaaagcagctgaagcaccaagtagatcatcagaaggaactcctctcttgtaaatcagaggaactgcgcgtaatgtctgaacgtgtgcaggaaagcatgtcttcagagatgctggctcttcaaattgagctgacagaaatggagagtatgaagaccaccctcaaagaagaagtgaatgaactacaatacagacaagaacagctagaacttcttattactaacctaatgcgccaggtagaccggcttaaagaggaaaaagaggagcgagagaaagaagcagtttcttactataatgccctagagaaagctcgtg

SEQ ID NO: 185973 - DNA, 552 bp, Homo sapiens
  Payload ID: 16619
  Gene Symbol: SPDL1
  Gene Name: spindle apparatus coiled-coil protein 1
  ENST ID: ENST00000515224
  CDS Start-End: 288-552
ctcgcgggaactgcattcaaatatcccaggcgcttactcgagagctagctgagcgaatgggccggcgactgtggagttagcgtcctcaatgtggacgccctgagctcccattaggagccgctggctgcggcagcaggggactagcgtgagagaatggaacctagtatataaggcattcaagaaatactcgttcagtgaatgactacattgacttgagacatgggggaacatcttgcaatgacctggtgccctttgaaggcaaagttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagttatgaacaagaaaaatatacccttcaaagagaagttgaactcaagagtcgaatgttagaaagtttgagctgcgaatgtgaagctattaaacaacaacaaaaaa

SEQ ID NO: 185974 - DNA, 2144 bp, Homo sapiens
  Payload ID: 16619
  Gene Symbol: SPDL1
  Gene Name: spindle apparatus coiled-coil protein 1
  ENST ID: ENST00000507232
  CDS Start-End: 164-298
gcattcaaatatcccaggcgcttactcgagagctagctgagcgaatgggccggcgactgtggagttagcgtcctcaatgtggacgccctgagctcccattaggagccgctggctgcggcagcaggggactagcgtgagagttggctaaaaaaaagaaaagaacatggaggcagatataatcacaaatcttcgatgcaggctcaaagaggctgaagaagagcgactaaaagctgcacaagttatgaacaagaaaaatatacccttcaaagagaagttgaactcaagagtcgaatgttagaaagtttgagctgcgaatgtgaagctattaaacaacaacaaaaaatgcacctggagaaattggaagaacaactaagcagaagccatggacaggaagtgaatgaactaaaaactaagatagaaaaactgaaagtggaattagatgaagccaggcttagtgaaaagcagctgaagcaccaagtagatcatcagaaggaactcctctcttgtaaatcagaggaactgcgcgtaatgtctgaacgtgtgcaggaaagcatgtcttcagagatgctggctcttcaaattgagctgacagaaatggagagtatgaagaccaccctcaaagaagaagtgaatgaactacaatacagacaagaacagctagaacttcttattactaacctaatgcgccaggtagaccggcttaaagaggaaaaagaggagcgagagaaagaagcagtttcttactataatgccctagagaaagctcgtgtagcaaatcaagatcttcaggtacagttggaccaggcactccagcaagccttggatcccaatagtaaaggcaactctttgtttgcagaggtggaagatcgaagggcagcaatggaacgtcagctcatcagtatgaaagtcaagtatcagtcactaaagaagcaaaatgtatttaacagagaacagatgcagagaatgaagttacaaattgccacgttgctacagatgaaagggtctcaaactgaatttgagcagcaggaacggttgcttgccatgttggagcagaagaatggtgaaataaaacatcttttaggtgaaattagaaatctggagaaatttaagaatttatatgacagtatggaatctaagccttcagtcgactctggtactctggaagataacacctattatacagatttacttcagatgaagctggataacttaaacaaagaaattgaaagcactaaaggtgaattgtccatacagcgaatgaaagcattatttgagagccagcgggctctagatattgagcgaaaactttttgcaaatgaaagatgcctccagctttcagaaagtgaaaatatgaaactgagagctaaactagatgaattgaaactaaaatatgaacctgaagagacagttgaagtgcctgtactgaaaaagaggcgtgaggtgctccctgtggatataaccaccgctaaagatgcatgtgtcaacaacagtgctctcgggggagaagtttatcgattaccgcctcagaaagaggagacacagtcctgccctaacagtttagaagataacaacttgcaattagaaaaatcagtttctatatacacaccagtagtcagtctctctcctcacaaaaatctgcccgtggatatgcagctgaagaaggaaaagaaatgtgtgaaactcataggagttcccgctgacgctgaggccttaagtgaaagaagtggaaacacccctaactctcccaggtcagtgtcctcttttcctccaggcagccagcagacctctccatctctcctctctcgctgcatgaactgtgctgtctgtttctttatctactttcttacaattgcatgcagtataattcctcagtttcatctacctaccttcaacttttccagaactttaagaaagactaaactgattgcaaagggaaaggactcttgaataaggcaatcacattaaaaagttacacgtttctgtttcatgaaagggaatatcacagtttaacacatctctgaatgttttatcagtttgaatacatgtactgttatttttctcctggttcaagcatggccatgaaagaaaaattaacttactttctcaaagggctttccagtagtctaagaaatttcagccttcta

SEQ ID NO: 185975 - DNA, 623 bp, Homo sapiens
  Payload ID: 16619
  Gene Symbol: SPDL1
  Gene Name: spindle apparatus coiled-coil protein 1
  ENST ID: ENST00000508247
  CDS Start-End: 175-623
atcccaggcgcttactcgagagctagctgagcgaatgggccggcgactgtggagttagcgtcctcaatgtggacgccctgagctcccattaggagccgctggctgcggcagcaggggactagcgtgagagttttatttcctctatttacagttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagttatgaacaagaaaaatatacccttcaaagagaagttgaactcaagagtcgaatgttagaaagtttgagctgcgaatgtgaagctattaaacaacaacaaaaaatgcacctggagaaattggaagaacaactaagcagaagccatggacaggaagtgaatgaactaaaaactaagatagaaaaactgaaagtggaattagatgaagccaggcttagtgaaaagcagctgaagcaccaagtagatcatcagaaggaactcctctcttgtaaatcagaggaactgcgcgt

SEQ ID NO: 185976 - DNA, 369 bp, Homo sapiens
  Payload ID: 16619
  Gene Symbol: SPDL1
  Gene Name: spindle apparatus coiled-coil protein 1
  ENST ID: ENST00000503871
  CDS Start-End: 1-68
aattggataaatgtcgtaatgaaatgatgaccatgactgagcagagattacttgacttgacgtgttgacataccatggagcacattttacttccttgacaaggcacagaagcagtaagagttatgaacaagaaaaatatacccttcaaagagaagttgaactcaagagtcgaatgttagaaagtttgagctgcgaatgtgaagctattaaacaacaacaaaaaatgcacctggagaaattggaagaacaactaagcagaagccatggacaggaagtgaatgaactaaaaactaagatagaaaaactgaaagtggaattagatgaagccaggcttagtgaaaagcagctgaagcaccaagtagatcatca

SEQ ID NO: 185977 - DNA, 667 bp, Homo sapiens
  Payload ID: 16619
  Gene Symbol: SPDL1
  Gene Name: spindle apparatus coiled-coil protein 1
  ENST ID: ENST00000512028
  CDS Start-End: 126-308
gagcgaatgggccggcgactgtggagttagcgtcctcaatgtggacgccctgagctcccattaggagccgctggctgcggcagcaggggactagcgtgagagttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagattacttgacttgacgtgttgacataccatggagcacattttacttccttgacaaggcacagaagcagtaagagttatgaacaagaaaaatatacccttcaaagagaagttgaactcaagagtcgaatgttagaaagtttgagctgcgaatgtgaagctattaaacaacaacaaaaaatgcacctggagaaattggaagaacaactaagcagaagccatggacaggaagtgaatgaactaaaaactaagatagaaaaactgaaagtggaattagatgaagccaggcttagtgaaaagcagctgaagcaccaagtagatcatcagaaggaactcctctcttgtaaatcagaggaactgcgcgtaatgtctgaacgtgtgcag

SEQ ID NO: 185978 - DNA, 559 bp, Homo sapiens
  Payload ID: 16619
  Gene Symbol: SPDL1
  Gene Name: spindle apparatus coiled-coil protein 1
  ENST ID: ENST00000509785
  CDS Start-End: 300-482
gagcgaatgggccggcgactgtggagttagcgtcctcaatgtggacgccctgagctcccattaggagccgctggctgcggcagcaggggactagcgtgagagtttcatgagggaggagcttttttttcgtccattttgttccctaatgaatctgaactgcccagaatggaacctagtatataaggcattcaagaaatactcgttcagtgaatgactacattgacttgagacatgggggaacatcttgcaatgacctggtgccctttgaaggcaaagttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagattacttgacttgacgtgttgacataccatggagcacattttacttccttgacaaggcacagaagcagtaagagttatgaacaagaaaaatataccctt

SEQ ID NO: 185979 - DNA, 637 bp, Homo sapiens
  Payload ID: 16619
  Gene Symbol: SPDL1
  Gene Name: spindle apparatus coiled-coil protein 1
  ENST ID: ENST00000513795
  CDS Start-End: 162-637
cttatacactgggttccgagccggtcttatcttccgctggaccacctcgccgccctcagggattctggacaaatatggaacgttgggtcggttgccgggtcctcaaaattataaccgccactggatctgcgctgtgcgttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagttatgaacaagaaaaatatacccttcaaagagaagttgaactcaagagtcgaatgttagaaagtttgagctgcgaatgtgaagctattaaacaacaacaaaaaatgcacctggagaaattggaagaacaactaagcagaagccatggacaggaagtgaatgaactaaaaactaagatagaaaaactgaaagtggaattagatgaagccaggcttagtgaaaagcagctgaagcaccaagtagatcatcagaaggaactcctctcttgtaaatcagaggaactgcgcgtaatgtctgaacgtgtgcaggaaagcat

SEQ ID NO: 185980 - DNA, 936 bp, Homo sapiens
  Payload ID: 16619
  Gene Symbol: SPDL1
  Gene Name: spindle apparatus coiled-coil protein 1
  ENST ID: ENST00000505977
  CDS Start-End: 1-936
gttagaaagtttgagctgcgaatgtgaagctattaaacaacaacaaaaaatgcacctggagaaattggaagaacaactaagcagaagccatggacaggaagtgaatgaactaaaaactaagatagaaaaactgaaagtggaattagatgaagccaggcttagtgaaaagcagctgaagcaccaagtagatcatcagaaggaactcctctcttgtaaatcagaggaactgcgcgtaatgtctgaacgtgtgcaggaaagcatgtcttcagagatgctggctcttcaaattgagctgacagaaatggagagtatgaagaccaccctcaaagaagaagtgaatgaactacaatacagacaagaacagctagaacttcttattactaacctaatgcgccaggtagaccggcttaaagaggaaaaagaggagcgagagaaagaagcagtttcttactataatgccctagagaaagctcgtgtagcaaatcaagatcttcaggtacagttggaccaggcactccagcaagccttggatcccaatagtaaaggcaactctttgtttgcagaggtggaagatcgaagggcagcaatggaacgtcagctcatcagtatgaaagtcaagtatcagtcactaaagaagcaaaatgtatttaacagagaacagatgcagagaatgaagatgaaagggtctcaaactgaatttgagcagcaggaacggttgcttgccatgttggagcagaagaatggtgaaataaaacatcttttaggtgaaattagaaatctggagaaatttaagaatttatatgacagtatggaatctaagccttcagtcgactctggtactctggaagataacacctattatacagatttacttcagatgaagctggataacttaaacaaagaaattgaaagcactaaaggtgaattgtccataca

SEQ ID NO: 185981 - DNA, 340 bp, Homo sapiens
  Payload ID: 16619
  Gene Symbol: SPDL1
  Gene Name: spindle apparatus coiled-coil protein 1
  ENST ID: ENST00000629457
  CDS Start-End: 158-340
aaatatcccaggcgcttactcgagagctagctgagcgaatgggccggcgactgtggagttagcgtcctcaatgtggacgccctgagctcccattaggagccgctggctgcggcagcaggggactagcgtgagagttggctaaaaaaaagaaaagaacatggaggcagatataatcacaaatcttcgatgcaggctcaaagaggctgaagaagagcgactaaaagctgcacagtatggtttacaactagtagagagtcaaaatgaattacagaatcaattggataaatgtcgtaatgaaatgatgaccatgactgagagattacttgacttgacgtgttga

SEQ ID NO: 185982 - DNA, 4484 bp, Homo sapiens
  Payload ID: 16620
  Gene Symbol: SPIN1
  Gene Name: spindlin 1
  Uniprot ID: Q9Y657
  ENST ID: ENST00000375859
  CDS Start-End: 279-1067
tccgcggcgagggagcgggggcggggaggcgccgtctggctcaggctggggccggcgggagcgcgaacgagcgacggcggaacccgtgggcctgtggactgcagcctcggcggtcagcagagtgcttgtgatttcacgtatttttgctgaactcgtaaaagagacacttggatggtggattaaccagaacactaacattctgtgaaaagtttcaaattggagaatattgaattttcaccctagtccagcagctccgctgctcacttaaatacagatgaatgaagaccccattcggaaagacacctggccagcggtccagagctgatgcaggccatgctggagtatctgccaacatgatgaagaagaggacatcccacaaaaaacatcggagcagtgtgggtccgagcaaacctgtttcccagccccggcggaacatcgtaggctgcaggattcagcatgggtggaaagaggggaatggccctgttacccagtggaaaggaaccgttctggaccaggtgcctgtaaatccttctttgtatcttataaaatacgatggatttgactgtgtttatggactagaacttaataaagatgaaagagtttctgcgcttgaagtcctccctgatagagttgcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccaatgattcacctccagcagaaagggaaccaggagaagttgtggacagcctggtaggcaaacaagtggaatatgccaaagaagatggctcgaaaaggactggcatggtcattcatcaagtagaagccaagccctccgtctatttcatcaagtttgatgatgatttccatatttatgtctacgatttggtgaaaacatcctagatgtcatcacaaactctgccaaatttgtggaactatgaaatgtattatttgtagacataaagacttgattgctttccagtttaatgaaagcttaaatgtccctgcgaacccacaatctctgccagcagaactggttttgttctgaatagtacagattgatgtgaacacaaagcattttgtgtaaggagaacccctttcttttaaaagaagtctgtctatttcgaggggagttacaggcaagtttggtaaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcagtcatggatatgatatcactgctctttatttaaaagtaaactttgggcacaggaaccatatgggaacattcagcttgtttaaaaaaaaaaaatcagaagttcagagcaccttttcaatctggagcccttaaaccataagtccaaatatgaattatttgtgaacagttaatgacccatattagaattttacaatctggtgaacaatctgggtaaaaggctacctttaattctaagcttcatttttttttgggggggggttacattttaatcataaattcttttttgcaaagcccaggttcttgttccacacagtgtaatgtaggtgtattttggacagcacatatggtccattgtgtacaagtcagtaatctggatttcagtacatggatttaaaaggcaacaatccatcactggtttgtgtgtttttggttaagtttctggaagaatacaatgcttttatattggaagtataagttttgagtggcattgttgccttctaacaagctctctgggacttttaaagttttattactattattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgcttggtaggtgtaagtaatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgcaacatgatgatggtgatgatgacgatgagtttaatcattgttcatttattgcctttagggctgagggaaagggaaggtttgtttttttttctccccattttcccccattctgtctttcttttggtgacttacaccacatgtaatgacgctatgactaattctgctcccaagcccttgtatcttgggcttcattttaggctcatgtgtcagatctgcatgcattgcttgcatttttctggtatctgaatgttggttccttgttccaggaattcaacattaatttccaaaagtatcatgggacttgtgacaatacaagacatgaatctatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcaaatgtagtgccaacagaaggtgattttccagttgtaaatgtcatgcagcatttgaagggactgtgttttcttaaaaaaaaatcacagttacttctaaaccagatttcatttcttttattgttttatgtgccaaaccacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataacaaaataattatggttgaaatgtctgtggttccttggaaatgctgcgctctttgtgtttttccatcattagtgcagttggaatgaatgtgtataggtcagaggtcttcgtgttcacattttaaaattaggtaaatgacctcatctttcaagcttgaattcatttttaattttaattttattttatacaatgtgtagacagttccctgttctctgcatttagaagtatacacaatataaatctgttaattctgtaagtaatttttataattatgatgtaactctatcttatccttaaaacatttaaaataaaccctttatgtgcaa

SEQ ID NO: 185983 - DNA, 1319 bp, Homo sapiens
  Payload ID: 16621
  Gene Symbol: SPIN2A
  Gene Name: spindlin family, member 2A
  Uniprot ID: Q99865
  ENST ID: ENST00000374906
  CDS Start-End: 372-1148
ggagcccaggaggggccccaagaaaagaaaggcagatctgctctgtgattagaatggaagacatcactactaagaggaaactaacactgtagtcttgtgcagaaaaagggcagagactacagccactgcatcagggactggtggcagcccaacgtggctgaggggtggccgccaccaacagggaggtagacggccagcgagcgaagcgctggggacaccgctgcagtgctctttgcctgtctcgccgcgctcctacacacgctcctcatctatggatcctaccctccccgctcttgcaagcagtcactcagcgagtcgcctgttgaccctccttcgccacaggctcacagcagaggcagcatcgagcaggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcaggtgcctataaatccctctctttatctggtgaaatatgatggaattgactgtgtctatggactggaacttcacagagatgaaagggttttgtctcttaaaattctttctgacagggtggcatcatctcacattagtgatgccaaccttgcaaataccataattggcaaagcagtggaacacatgtttgagggagagcatggttctaaggatgaatggagggggatggtcttagctcaagcacctatcatgaaagcctggttttatattacctatgagaaagatcctgtcttgtacatgtaccagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaaaccaaaccctctgtgtatttcatcaagtttgatgatgatttccatatctatgtctacgatttggtgaaaaagtcctaactgttagggtaaaatttggcacatgtgtggaaacaaatgtataatttgtagacatgcaaaaaatgttgcctttcagtgtactgaaagcttatggaatccctgataactaaacatctttgccagcattaactgttgttttgctctaaaaaatacaaatttgtgaatacatga

SEQ ID NO: 185984 - DNA, 2468 bp, Homo sapiens
  Payload ID: 16621
  Gene Symbol: SPIN2A
  Gene Name: spindlin family, member 2A
  Uniprot ID: Q99865
  ENST ID: ENST00000374908
  CDS Start-End: 401-1177
ggcagtgggggttacagacagcaccagaggcactcagggcaggagggtagtgggtgctggtcaaggccgctttgcaggggattgggagtggatgctagtggcagtaaagggtaaagggagggcagtgggctctgagctaggaggaggtggcccagccacttctgcagagttcctaaccccagacagctctactgcaccaccccagcccttccccacagcccaaaggaacttaagagggagagcactgcgggcatgcagccaggatttccagcattgcttccaggctcctaggggaaacttaggcactagcgcagactacatccagacatggctatagggaaaagtttgccttgtggcacactgggtgtgtctctctatcctctctcctcccccagcaggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcaggtgcctataaatccctctctttatctggtgaaatatgatggaattgactgtgtctatggactggaacttcacagagatgaaagggttttgtctcttaaaattctttctgacagggtggcatcatctcacattagtgatgccaaccttgcaaataccataattggcaaagcagtggaacacatgtttgagggagagcatggttctaaggatgaatggagggggatggtcttagctcaagcacctatcatgaaagcctggttttatattacctatgagaaagatcctgtcttgtacatgtaccagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaaaccaaaccctctgtgtatttcatcaagtttgatgatgatttccatatctatgtctacgatttggtgaaaaagtcctaactgttagggtaaaatttggcacatgtgtggaaacaaatgtataatttgtagacatgcaaaaaatgttgcctttcagtgtactgaaagcttatggaatccctgataactaaacatctttgccagcattaactgttgttttgctctaaaaaatacaaatttgtgaatacatgacatgctgtctgtaagccctttgtcttgttgaaaagttcgggtgtgtttggtagatggggcatggaaggaacgaacagctgtcaatttcggctgtgaataaagttcagctagaatcataatcagtcatttaaaaatggcactggatttagctggtctggtctggagggggcaggggaaggaacaagagattggctgtcttggggagagaggaggaggtgactgcttaggaagaggtggaaaagggccagaaagggaggggctccttgggggaggggatgacctatgagaaggaaacatccaactcagaaggaagactaacagagggagagtgagatcttggggcttagaggaaaatagaataaactgagtagagaggaacacaaagaagcttagaagagggtccagagtaaggtggagaaggatcaacctgacagggatctgggagaggctaaaggatacacaaaggaagaggctatgtgggttagggtgttggagggattagaagagggccactgaggaaggaggaattcaaagaagaaagactgacagagggagtgagaatacaggaaaagagttgtggggtatggggcccatgagagatcggaaggcccaggaaaatgttggacttctggtagtgtccacattgctcttcctggctctatgcacaaaggaagtggcaactgtcaaagatgccagatgcattggaggttcactagaagagcatgttgacaggaatgactcagtcaagttaatcaggagccaagtttatgcccataaggcttttcctgtttcagggagttaatgacacacttgtccagcagaaacccaatgctcagcctaaacacgctaacatggtgccccacatgtgctgggctgtgggctgcctcctcacatttgtcctgcgctagataagcaatcttggtagaggatgggttagtggggctctcagaacttaagagatgtgccatcttgcatttggaaagtactttatccagaaaaaatgaaatcttactgaactcaggtacagcagtctcatcactcctattccttctgctggaatgtttgttttctatctagagatgaggggcatcagaggactgagcctagtgtttctctcgag

SEQ ID NO: 185985 - DNA, 966 bp, Homo sapiens
  Payload ID: 16621
  Gene Symbol: SPIN2A
  Gene Name: spindlin family, member 2A
  ENST ID: ENST00000614076
  CDS Start-End: 322-795
aaaaagggcagagactacagccactgcatcagggactggtggcagcccaacgtggctgaggggtggccgccaccaacagggaggtagacggccagcgagcgaagcgctggggacaccgctgcagtgctctttgcctgtctcgccgcgctcctacacacgctcctcatctatggatcctaccctccccgctcttgcaagcagtcactcagcgagtcgcctgttgaccctccttcgccacaggctcacagcagaggcagcatcgaggtatccgatttcggcacgtgaggcccgcgatccccggcggtggacgccaggcagggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaaaccaaaccctctgtgtatttcatcaagtttgatgatgatttccatatctatgtctacgatttggtgaaaaagtcctaactgttagggtaaaatttggcacatgtgtggaaacaaatgtataatttgtagacatgcaaaaaatgttgcctttcagtgtactgaaagcttatggaatccctgataactaaacatctttgccagcattaactgttgttttgctctaaaaaatacaaatttgtgaatacatga

SEQ ID NO: 185986 - DNA, 1152 bp, Homo sapiens
  Payload ID: 16622
  Gene Symbol: SPIN2B
  Gene Name: spindlin family, member 2B
  Uniprot ID: Q9BPZ2
  ENST ID: ENST00000275988
  CDS Start-End: 205-981
gccaccgccagcagggaggcggagggctagcgagccaagcggtggggacgccgctgccttcctctttgcctgtctcgccgccctcctagacacgctcctcatctacggatcctaccctccccgctcttgcaagcattcactcggccggtcgcctgctgaccctccttcgccacaggctcgtagcggaggcagcagcgagcaggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcaggtgcctataaatccctctctttatctggtgaaatatgatggaattgactgtgtctatggactggaacttcacagagatgaaagggttttgtctcttaaaattctttctgacagggtggcatcatctcacattagtgatgccaaccttgcaaataccataattggcaaagcagtggaacatatgtttgagggagagcatggttctaaggatgaatggagggggatggtcttagctcaagcacctatcatgaaagcctggttttatattacctatgagaaagatcctgtcttgtacatgtaccagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaagccaaaccctctgtgtatttcatcaagtttgatgatgatttccatatctatgtctacgatttggtgaaaaagtcctaactgttagggtaaaatttggcacatgtgtggaaacaaatgtataatttgtagacatgcaaaaaatgttgcctttcagtgtattgaaagcttatggaatccctgataactaaacatctttgccagcattaactgttgttttgctctaaaaaatacaaacttgtgtgtacatga

SEQ ID NO: 185987 - DNA, 1258 bp, Homo sapiens
  Payload ID: 16622
  Gene Symbol: SPIN2B
  Gene Name: spindlin family, member 2B
  Uniprot ID: Q9BPZ2
  ENST ID: ENST00000333933
  CDS Start-End: 312-1088
gagactgccgcggcgacagcagggactggtggaatcccgatgtggctgaggggccgccaccgccagcagggaggcggagggctagcgagccaagcggtggggacgccgctgccttcctctttgcctgtctcgccgccctcctagacacgctcctcatctacggatcctaccctccccgctcttgcaagcattcactcggccggtcgcctgctgaccctccttcgccacaggctcgtagcggaggcagcagcgaggtgtccgatttgggcacgtgaggcccgcgatccccggcggtggacgccaggcagggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcaggtgcctataaatccctctctttatctggtgaaatatgatggaattgactgtgtctatggactggaacttcacagagatgaaagggttttgtctcttaaaattctttctgacagggtggcatcatctcacattagtgatgccaaccttgcaaataccataattggcaaagcagtggaacatatgtttgagggagagcatggttctaaggatgaatggagggggatggtcttagctcaagcacctatcatgaaagcctggttttatattacctatgagaaagatcctgtcttgtacatgtaccagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaagccaaaccctctgtgtatttcatcaagtttgatgatgatttccatatctatgtctacgatttggtgaaaaagtcctaactgttagggtaaaatttggcacatgtgtggaaacaaatgtataatttgtagacatgcaaaaaatgttgcctttcagtgtattgaaagcttatggaatccctgataactaaacatctttgccagcattaactgttgttttgctctaaaaaatacaaacttgtgtgtacatg

SEQ ID NO: 185988 - DNA, 725 bp, Homo sapiens
  Payload ID: 16622
  Gene Symbol: SPIN2B
  Gene Name: spindlin family, member 2B
  ENST ID: ENST00000374910
  CDS Start-End: 81-554
ctcgtagcggaggcagcagcgaggtgtccgatttgggcacgtgaggcccgcgatccccggcggtggacgccaggcagggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaagccaaaccctctgtgtatttcatcaagtttgatgatgatttccatatctatgtctacgatttggtgaaaaagtcctaactgttagggtaaaatttggcacatgtgtggaaacaaatgtataatttgtagacatgcaaaaaatgttgcctttcagtgtattgaaagcttatggaatccctgataactaaacatctttgccagcattaactgttgttttgctctaaaaaatacaaacttgtgtgtacatga

SEQ ID NO: 185989 - DNA, 1205 bp, Homo sapiens
  Payload ID: 16622
  Gene Symbol: SPIN2B
  Gene Name: spindlin family, member 2B
  Uniprot ID: Q9BPZ2
  ENST ID: ENST00000374912
  CDS Start-End: 258-1034
ggagactgccgcggcgacagcagggactggtggaatcccgatgtggctgaggggccgccaccgccagcagggaggcggagggctagcgagccaagcggtggggacgccgctgccttcctctttgcctgtctcgccgccctcctagacacgctcctcatctacggatcctaccctccccgctcttgcaagcattcactcggccggtcgcctgctgaccctccttcgccacaggctcgtagcggaggcagcagcgaggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcaggtgcctataaatccctctctttatctggtgaaatatgatggaattgactgtgtctatggactggaacttcacagagatgaaagggttttgtctcttaaaattctttctgacagggtggcatcatctcacattagtgatgccaaccttgcaaataccataattggcaaagcagtggaacatatgtttgagggagagcatggttctaaggatgaatggagggggatggtcttagctcaagcacctatcatgaaagcctggttttatattacctatgagaaagatcctgtcttgtacatgtaccagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaagccaaaccctctgtgtatttcatcaagtttgatgatgatttccatatctatgtctacgatttggtgaaaaagtcctaactgttagggtaaaatttggcacatgtgtggaaacaaatgtataatttgtagacatgcaaaaaatgttgcctttcagtgtattgaaagcttatggaatccctgataactaaacatctttgccagcattaactgttgttttgctctaaaaaatacaaacttgtgtgtacatga

SEQ ID NO: 185990 - DNA, 1050 bp, Homo sapiens
  Payload ID: 16622
  Gene Symbol: SPIN2B
  Gene Name: spindlin family, member 2B
  ENST ID: ENST00000434397
  CDS Start-End: 309-1050
actgccgcggcgacagcagggactggtggaatcccgatgtggctgaggggccgccaccgccagcagggaggcggagggctagcgagccaagcggtggggacgccgctgccttcctctttgcctgtctcgccgccctcctagacacgctcctcatctacggatcctaccctccccgctcttgcaagcattcactcggccggtcgcctgctgaccctccttcgccacaggctcgtagcggaggcagcagcgaggtgtccgatttgggcacgtgaggcccgcgatccccggcggtggacgccaggcagggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcaggtgcctataaatccctctctttatctggtgaaatatgatggaattgactgtgtctatggactggaacttcacagagatgaaagggttttgtctcttaaaattctttctgacagggtggcatcatctcacattagtgatgccaaccttgcaaataccataattggcaaagcagtggaacatatgtttgagggagagcatggttctaaggatgaatggagggggatggtcttagctcaagcacctatcatgaaagcctggttttatattacctatgagaaagatcctgtcttgtacatgtaccagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaagccaaaccctctgtgtatttcatcaagtttgatgatgatttcc

SEQ ID NO: 185991 - DNA, 1100 bp, Homo sapiens
  Payload ID: 16623
  Gene Symbol: SPIN3
  Gene Name: spindlin family, member 3
  Uniprot ID: Q5JUX0
  ENST ID: ENST00000374919
  CDS Start-End: 324-1100
tgcggcgcagcagcgactagtgggagtccgatgtgggagaggggctgcggccaccgccaccgccgccgccaccaggaaggcggaggacgcaggagccaagagcaagggacgccgccacggtcatcttcgcctgccccgccgccctcttagagacactcattgcctatggatcatcctctcccagcttttgcaagcaccgggctgctcgcccgctgattttcctcctccataggctcactgcggaggcaacggcgaggtgtccgatttgtgcacttgaggcccgcaatccgggacggtggggaatctgcgcctcctggccgggcatgaagaccccgtttggaaaggcagctgcagggcagcggtccaggacgggcgctggccacggcagtgtgtctgttaccatgataaagaggaaggctgcacacaagaagcataggagccgacccacctcccagcctcgggggaacatcgtgggctgcagaattcagcacggatggaaagatggagatgaacctctaacacagtggaaaggaaccgttctggatcaggtacctgtaaatccctctctgtatcttatcaaatatgatggatttgactgtgtttatggattggaacttcacagagatgaaagagtgtcatcacttgaagtccttcctaatagagttgcatcatctagaatcagtgatacacacttggcagaaataatggttggcaaagcagtggaacatatttttgagacagaggaaggttccaaaaatgaatggagggggatggtcttagctcaggcacctgtcatgaacacatggttttacattacctatgagaaagatcctgtattatatatgtaccagctcttagatgattataaagatggtgacctccgcatccttcaagattccaatgattctcctctggcagagagggagccaggagaagtcatagacagcctggtaggcaaacaggtggaatacgccaaagacgatggctccaagagaactggcatggtcattcatcaggtagaagcaaaaccctctgtgtacttcatcaaatttgatgatgatttccatatctatgtctacgatttggtaaaaacatcttag

SEQ ID NO: 185992 - DNA, 1620 bp, Homo sapiens
  Payload ID: 16623
  Gene Symbol: SPIN3
  Gene Name: spindlin family, member 3
  Uniprot ID: Q5JUX0
  ENST ID: ENST00000478405
  CDS Start-End: 287-520
agcgactagtgggagtccgatgtgggagaggggctgcggccaccgccaccgccgccgccaccaggaaggcggaggacgcaggagccaagagcaagggacgccgccacggtcatcttcgcctgccccgccgccctcttagagacactcattgcctatggatcatcctctcccagcttttgcaagcaccgggctgctcgcccgctgattttcctcctccataggctcactgcggaggcaacggcgaggtgtccgatttgtgcacttgaggcccgcaatccgggacggcatgaagaccccgtttggaaaggcagctgcagggcagcggtccaggacgggcgctggccacggcagtgtgtctgttaccatgataaagaggaaggctgcacacaagaagcataggagccgacccacctcccagcctcgggggaacatcgtgggctgcagaattcagcacggatggaaagatggagatgaacctctaacacagtggaaaggaaccgttctggatcagctcctttgaataaacctgcccaccaccaagaacccatacatgactttcttttcattgtatcaaagtaatgtgtccaccggtgtgagcaccagcaactcacttcttcctcagacatctctaaagctggaaagattttgagggacaatatggtttccttcaccccacaccaatgttatgaatgagaccagcagaccaacagcaaacacctagaaggaacagctgttcttcatgggtgactgctgtgaaaccaacaggatggcctcttttctatttaatcctaagagtgggcataaggtaaaatattgggtaggtcctttggagttctagactcagtttgagattacagaagatatgctcaacatcctcctttgacctggtcccagtttcaccatatttgctagatgctttatagtctctggtaaggaggtgtacaattctctgattttatttcagtttttagggaattttattttgttcatttcaacaagaaaaattacataaacaggtaacagctccactcaaagctgttttaaatgaacaaaatattggactttgtgaacaaatatgatactttttctttctgcaattattggctagcaatcttattttactaaatctatactgacaaatttaatttggtccatttatttgagtttaaagactatttcaaactctccccagtgaaacagtcatgggccattgctatcctcaaaagaactaaatatataaatagcagctttcctcaaaaaagatgataaagtcttcttttccctttagagcataaatttcagtggcaggtaaaactattttagcaacaatatgctcacttcttccatgatatgtttttcttccctactaagttgaaagtttttctcagtttccatagccactcacaagtttttctctacctaactgaagttgccctcttctgctggtcattaggacattaacttttagaatgatttctgtttcagcctcttgttttgaaggcaggcttttaatttcctcagagaaattgcaatggaacgaaaatttgttctctcttttacatatgtacacttgtataagagatgtaatgtttttaaataaaatttttaattcatgcaaaa

SEQ ID NO: 185993 - DNA, 1670 bp, Homo sapiens
  Payload ID: 16623
  Gene Symbol: SPIN3
  Gene Name: spindlin family, member 3
  Uniprot ID: Q5JUX0
  ENST ID: ENST00000475785
  CDS Start-End: 325-558
ctgcggcgcagcagcgactagtgggagtccgatgtgggagaggggctgcggccaccgccaccgccgccgccaccaggaaggcggaggacgcaggagccaagagcaagggacgccgccacggtcatcttcgcctgccccgccgccctcttagagacactcattgcctatggatcatcctctcccagcttttgcaagcaccgggctgctcgcccgctgattttcctcctccataggctcactgcggaggcaacggcgaggtgtccgatttgtgcacttgaggcccgcaatccgggacggtggggaatctgcgcctcctggccgggcatgaagaccccgtttggaaaggcagctgcagggcagcggtccaggacgggcgctggccacggcagtgtgtctgttaccatgataaagaggaaggctgcacacaagaagcataggagccgacccacctcccagcctcgggggaacatcgtgggctgcagaattcagcacggatggaaagatggagatgaacctctaacacagtggaaaggaaccgttctggatcagctcctttgaataaacctgcccaccaccaagaacccatacatgactttcttttcattgtatcaaagtaatgtgtccaccggtgtgagcaccagcaactcacttcttcctcagacatctctaaagctggaaagattttgagggacaatatggtttccttcaccccacaccaatgttatgaatgagaccagcagaccaacagcaaacacctagaaggaacagctgttcttcatgggtgactgctgtgaaaccaacaggatggcctcttttctatttaatcctaagagtgggcataaggtaaaatattgggtaggtcctttggagttctagactcagtttgagattacagaagatatgctcaacatcctcctttgacctggtcccagtttcaccatatttgctagatgctttatagtctctggtaaggaggtgtacaattctctgattttatttcagtttttagggaattttattttgttcatttcaacaagaaaaattacataaacaggtaacagctccactcaaagctgttttaaatgaacaaaatattggactttgtgaacaaatatgatactttttctttctgcaattattggctagcaatcttattttactaaatctatactgacaaatttaatttggtccatttatttgagtttaaagactatttcaaactctccccagtgaaacagtcatgggccattgctatcctcaaaagaactaaatatataaatagcagctttcctcaaaaaagatgataaagtcttcttttccctttagagcataaatttcagtggcaggtaaaactattttagcaacaatatgctcacttcttccatgatatgtttttcttccctactaagttgaaagtttttctcagtttccatagccactcacaagtttttctctacctaactgaagttgccctcttctgctggtcattaggacattaacttttagaatgatttctgtttcagcctcttgttttgaaggcaggcttttaatttcctcagagaaattgcaatggaacgaaaatttgttctctcttttacatatgtacacttgtataagagatgtaatgtttttaaataaaatttttaattcatgcaaaagcatgtctctaa

SEQ ID NO: 185994 - DNA, 4112 bp, Homo sapiens
  Payload ID: 16624
  Gene Symbol: SPIN4
  Gene Name: spindlin family, member 4
  Uniprot ID: Q56A73
  ENST ID: ENST00000335144
  CDS Start-End: 521-1270
ggtcgccagagtgaagccaagccagctagcgctgcgaagcccaggccgcgcggactccccagagacttgccgccgcctgcgcctttgccgctgcagccatccctcttactccttgcctttcgtccccgtcgtctcctctgccgccgtgccgcagccgcaccagcatcgacaacagctaagtggccgattcggggacttggggtcggggttggggcggacgcaaggcacgaacagcactcgcgagcccgccatctctacgtcagccgccactgctgcagtaacccttctagggcgagagaggaaagcactgtggagaggcacacgctgtcccagtgctcacggttagagttcgagcgtttctgccaaaaccttggtgagagccttgcacttggagaagggagcacagaccaggtctttgagatcgcaaaaaatatatatatcatattgcatagtgttgactttttgtcagtttaatcgaccagggcagcagctttccccaagccctcttaatccctgagctatgtctcctccaaccgtgcctccgatgggggtagatggcgtgtccgcatacctgatgaagaaaaggcacacccacaggaagcaacggcgcaagcccactttcctcactcgtaggaacatcgtgggctgccgcattcaacacggctggaaggaaggcaacgagccagtggagcagtggaagggtactgtgctcgagcaggtttccgtgaagcccactctttacatcattaaatatgatggcaaagatagtgtgtatggactagaactgcaccgcgataagagagttttagcgctagagatccttcctgagagagtgccaactcctcgtatcgattcacgactggcagattccctgattggcaaggcagtggagcatgtgtttgaaggtgaacatggtaccaaggatgaatggaagggtatggtcctggcgcgagctcctgtgatggatacttggttttacatcacctacgagaaagatcctgttctctatatgtacacgctgcttgatgactacaaagatggtgacttacgcattattccagattccaactactatttccctacagcagaacaggagcctggagaggtggtcgacagtctcgtgggcaagcaggtggagcatgccaaagatgacgggtccaagagaactggcatttttatacatcaagtggtggcgaagccatctgtttacttcattaagtttgatgatgatattcacatttatgtctatggtttggtgaaaactccttaaattctttgtgctctttagagaagttgtggatctgttagatgtgaattattttgtgttctcgtagttgtgaacgcagagaagagtttaggtgtcagaaattcaggaaagtggataaattttattgtgccaacaaatcttaccttgactagtttcacaattttgcctcaagtgtactttgctacttttgatattgccttgttctgtaacttaacagttaaattgggtgctaatagaaaattaaaaagtgtttgcaaccattggaacaatgcaaaaatagattaagaaaaattaatggtgtaaacccacaccccgtccttaccccttcctttccttaccttgtttcttcccagaaaacaagtgttgaggatgcgaagtacatccttccacctattttccccatcttcatgcagaaagtatgttctagtagtttctgtaaaaatggcaagccacatgcttttctcacttgacatgtagatgatatctcttcttatcagtagcttcagtctttcttgctctctctggctctctctggccctcactcttactctcttgcactcttgctctccccctccctcccttactctaacagctgaatacacagtacttgttgatgtaccaaaaaggcattcaaccatttcgttattgatcgtcttttatttcctttttttattttttttcaaaataacactgctgtaatacatactggtgcttttatttatataggttggattcccagaaatactatgtaggcatatgtttcagaaatattacaagattactatccaaaatgaaagcgcccgttccagcgtcctctccagcactctttaatgcttgaaaatatgaaaggctaaaaattgcattgtattgcttgttagtttaattgccttttgtctgagttcaaagaggtttgttgttgttgctgtccttgtttctgtttggatttttctctgatttgcctgttcttaccctttgctcatgtatctattgatgtttttcattataaatttgtagaaattcttactacatagtgcatattaatcatttgtagctctaatgtgttatgacgttttcatcttgactttattgatgatatattttcctttaaaatttttaaactttttaggtagacccttatctcttttatagattttggtttcctttttttatcacatggatgcccccacccaaagtcatacaaatattcacctacattttcttctaataactttattatttttaatgtttaaatgtttgatccatctgaaatttatttttgtatatggtgtaagatggggatccagctataacattttgttcacattggatacctgattgtgacatttatttaaaatgttacccattttcaaatttctgagccaatatcatgatttaattatagtggcttcatcgtaagttttagaatccgataaagcaagtcccacttcattagttttttttttctttatataatatgtcctagacattcattttttcatgtgaaaaaatgaaatgcagaattttaataaaattctaattatgatggctgacatcacaattaaaatcctgcatttttgtttagagggctctttaataatattaaatcttagcactcaagagtcttcgtacatcattgaaatcttttggtcttgttattggaatattcttcacgtaagtatatcatagctaactgaatttatttctaagtatttttacagttttatttcatattttgacattgtgaattggtttttttcttctcatttgtaattagctatttttgacaatatagacaacctatagatttttgtatttttatcttctgtctaatgagcttatttaatcattgaaattacagtagatttttaagaatataatattttgggttttctagatatgaaattatttcacctgaacatatagatcattttatttcctcttaatgtttatactgattactgttacattagctggatttttcaaaacaatgttgaagagtgatgacagacgtgactgtcttgttcttaattttcatggaagtaagaatgcaaaatattaatagggaatagtattccctattagtatgacatttacttttggttattagtaggtagtcattaacatgtttaagagtttccgctattcctgttttatagtgttattgctagaagtggttcctgaattttataaaatgccttttcagcatctattgataaaattgtatgattttttttctctttaatttgttgatgtaatgaattagaatggtaggcatttgatgtggaaccaaacttgtatttctggaacaaatactacttggtcattgtgaaataatgatttgctacatgagtggattttatttaccagtatttaatttagaattattgcattttcattccaaagtaaaattgtattttgtccttctgatgctatctttatcaagttttgttattgaagttgtgctagctttaaaaaaatatgaatatgtgagttttcaatttttttcctgtggtctggaataatttaaatagcattagaattatttgtttgttaaaagttagctaggacaaagtgtaaaacaatctaatcctgatgacacttttaatagtagatttttaatcagctttgtgatttctttaatagttattggtttattcaggctttttattaaaaaggtatatacattctctgtgacatacaaagttaaaagttctctattattgctgattgtactggttgttgcttgttgactgtactattcagatggctttatgcttttgtgtattttatgtcacctagatctaattctgaaaacattgtaataaaataattagctataatggta

SEQ ID NO: 185995 - DNA, 4117 bp, Homo sapiens
  Payload ID: 16624
  Gene Symbol: SPIN4
  Gene Name: spindlin family, member 4
  ENST ID: ENST00000374884
  CDS Start-End: 580-1275
gacccggtcgccagagtgaagccaagccagctagcgctgcgaagcccaggccgcgcggactccccagagacttgccgccgcctgcgcctttgccgctgcagccatccctcttactccttgcctttcgtccccgtcgtctcctctgccgccgtgccgcagccgcaccagcatcgacaacagctaagtggccgattcggggacttggggtcggggttggggcggacgcaaggcacgaacagcactcgcgagcccgccatctctacgtcagccgccactgctgcagtaacccttctagggcgagagaggaaagcactgtggagaggcacacgctgtcccagtgctcacggttagagttcgagcgtttctgccaaaaccttggtgagagccttgcacttggagaagggagcacagaccaggtctttgagatcgcaaaaaatatatatatcatattgcatagtgttgactttttgtcagtttaatcgaccagggcagcagctttccccaagccctcttaatccctgagctatgtctcctccaaccgtgcctccgatgggggtagatggcgtgtccgcatacctgatgaagaaaaggcacacccacaggaagcaacggcgcaagcccactttcctcactcgtaggaacatcgtgggctgccgcattcaacacggctggaaggaaggcaacgagccagtggagcagtggaagggtactgtgctcgagcaggtttccgtgaagcccactctttacatcattaaatatgatggcaaagatagtgtgtatggactagaactgcaccgcgataagagagttttagcgctagagatccttcctgagagagtgccaactcctcgtatcgattcacgactggcagattccctgattggcaaggcagtggagcatgtgtttgaaggtgaacatggtaccaaggatgaatggaagggtatggtcctggcgcgagctcctgtgatggatacttggttttacatcacctacgagaaagatcctgttctctatatgtacacgctgcttgatgactacaaagatggtgacttacgcattattccagattccaactactatttccctacagcagaacaggagcctggagaggtggtcgacagtctcgtgggcaagcaggtggagcatgccaaagatgacgggtccaagagaactggcatttttatacatcaagtggtggcgaagccatctgtttacttcattaagtttgatgatgatattcacatttatgtctatggtttggtgaaaactccttaaattctttgtgctctttagagaagttgtggatctgttagatgtgaattattttgtgttctcgtagttgtgaacgcagagaagagtttaggtgtcagaaattcaggaaagtggataaattttattgtgccaacaaatcttaccttgactagtttcacaattttgcctcaagtgtactttgctacttttgatattgccttgttctgtaacttaacagttaaattgggtgctaatagaaaattaaaaagtgtttgcaaccattggaacaatgcaaaaatagattaagaaaaattaatggtgtaaacccacaccccgtccttaccccttcctttccttaccttgtttcttcccagaaaacaagtgttgaggatgcgaagtacatccttccacctattttccccatcttcatgcagaaagtatgttctagtagtttctgtaaaaatggcaagccacatgcttttctcacttgacatgtagatgatatctcttcttatcagtagcttcagtctttcttgctctctctggctctctctggccctcactcttactctcttgcactcttgctctccccctccctcccttactctaacagctgaatacacagtacttgttgatgtaccaaaaaggcattcaaccatttcgttattgatcgtcttttatttcctttttttattttttttcaaaataacactgctgtaatacatactggtgcttttatttatataggttggattcccagaaatactatgtaggcatatgtttcagaaatattacaagattactatccaaaatgaaagcgcccgttccagcgtcctctccagcactctttaatgcttgaaaatatgaaaggctaaaaattgcattgtattgcttgttagtttaattgccttttgtctgagttcaaagaggtttgttgttgttgctgtccttgtttctgtttggatttttctctgatttgcctgttcttaccctttgctcatgtatctattgatgtttttcattataaatttgtagaaattcttactacatagtgcatattaatcatttgtagctctaatgtgttatgacgttttcatcttgactttattgatgatatattttcctttaaaatttttaaactttttaggtagacccttatctcttttatagattttggtttcctttttttatcacatggatgcccccacccaaagtcatacaaatattcacctacattttcttctaataactttattatttttaatgtttaaatgtttgatccatctgaaatttatttttgtatatggtgtaagatggggatccagctataacattttgttcacattggatacctgattgtgacatttatttaaaatgttacccattttcaaatttctgagccaatatcatgatttaattatagtggcttcatcgtaagttttagaatccgataaagcaagtcccacttcattagttttttttttctttatataatatgtcctagacattcattttttcatgtgaaaaaatgaaatgcagaattttaataaaattctaattatgatggctgacatcacaattaaaatcctgcatttttgtttagagggctctttaataatattaaatcttagcactcaagagtcttcgtacatcattgaaatcttttggtcttgttattggaatattcttcacgtaagtatatcatagctaactgaatttatttctaagtatttttacagttttatttcatattttgacattgtgaattggtttttttcttctcatttgtaattagctatttttgacaatatagacaacctatagatttttgtatttttatcttctgtctaatgagcttatttaatcattgaaattacagtagatttttaagaatataatattttgggttttctagatatgaaattatttcacctgaacatatagatcattttatttcctcttaatgtttatactgattactgttacattagctggatttttcaaaacaatgttgaagagtgatgacagacgtgactgtcttgttcttaattttcatggaagtaagaatgcaaaatattaatagggaatagtattccctattagtatgacatttacttttggttattagtaggtagtcattaacatgtttaagagtttccgctattcctgttttatagtgttattgctagaagtggttcctgaattttataaaatgccttttcagcatctattgataaaattgtatgattttttttctctttaatttgttgatgtaatgaattagaatggtaggcatttgatgtggaaccaaacttgtatttctggaacaaatactacttggtcattgtgaaataatgatttgctacatgagtggattttatttaccagtatttaatttagaattattgcattttcattccaaagtaaaattgtattttgtccttctgatgctatctttatcaagttttgttattgaagttgtgctagctttaaaaaaatatgaatatgtgagttttcaatttttttcctgtggtctggaataatttaaatagcattagaattatttgtttgttaaaagttagctaggacaaagtgtaaaacaatctaatcctgatgacacttttaatagtagatttttaatcagctttgtgatttctttaatagttattggtttattcaggctttttattaaaaaggtatatacattctctgtgacatacaaagttaaaagttctctattattgctgattgtactggttgttgcttgttgactgtactattcagatggctttatgcttttgtgtattttatgtcacctagatctaattctgaaaacattgtaataaaataattagctataatggta

SEQ ID NO: 185996 - DNA, 1948 bp, Homo sapiens
  Payload ID: 16625
  Gene Symbol: SPNS1
  Gene Name: spinster homolog 1 (Drosophila)
  Uniprot ID: Q9H2V7
  ENST ID: ENST00000352260
  CDS Start-End: 340-1704
ggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacctgggtagctcaggggaggaggtgggggtccaggagggggatccctctccacaggggcagccccaagggctcggtgctatttgtaacggaataaaatttgtagccaga

SEQ ID NO: 185997 - DNA, 2208 bp, Homo sapiens
  Payload ID: 16625
  Gene Symbol: SPNS1
  Gene Name: spinster homolog 1 (Drosophila)
  Uniprot ID: Q9H2V7
  ENST ID: ENST00000311008
  CDS Start-End: 378-1964
gtcacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacctgggtagctcaggggaggaggtgggggtccaggagggggatccctctccacaggggcagccccaagggctcggtgctatttgtaacggaataaaatttgtagccaga

SEQ ID NO: 185998 - DNA, 2102 bp, Homo sapiens
  Payload ID: 16625
  Gene Symbol: SPNS1
  Gene Name: spinster homolog 1 (Drosophila)
  Uniprot ID: Q9H2V7
  ENST ID: ENST00000323081
  CDS Start-End: 491-1858
gcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacctgggtagctcaggggaggaggtgggggtccaggagggggatccctctccacaggggcagccccaagggctcggtgctatttgtaacggaataaaatttgtagccaga

SEQ ID NO: 185999 - DNA, 2027 bp, Homo sapiens
  Payload ID: 16625
  Gene Symbol: SPNS1
  Gene Name: spinster homolog 1 (Drosophila)
  Uniprot ID: Q9H2V7
  ENST ID: ENST00000334536
  CDS Start-End: 352-1782
ggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacctgggtagctcaggggaggaggtgggggtccaggagggggatccctctccacaggggcagccccaagggctcggtgctatttgtaacggaataaaatttgtagccagac

SEQ ID NO: 186000 - DNA, 1979 bp, Homo sapiens
  Payload ID: 16625
  Gene Symbol: SPNS1
  Gene Name: spinster homolog 1 (Drosophila)
  ENST ID: ENST00000565975
  CDS Start-End: 9-1730
cgcgtcacatgaccggctttaagcaacatggcggctgccgtggtgcagcgcccgggctgagcgacagcaagtgcagcgggctcctaccccgggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacctgggtagctcaggggaggaggtgggggtccaggagggggatccctctccacaggggcagccccaagggctcggtgctatttgtaacggaataaaatttgtagccagacccca

SEQ ID NO: 186001 - DNA, 759 bp, Homo sapiens
  Payload ID: 16625
  Gene Symbol: SPNS1
  Gene Name: spinster homolog 1 (Drosophila)
  ENST ID: ENST00000568388
  CDS Start-End: 332-759
catccatcgcgctgctcaagctccatccatccatttatccatccatccatccatcctttattgagagtaaaaagccgccaaccagaccctgggaggaagacaggatggttcccgagaactagggctgctccttggcttttagagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactg

SEQ ID NO: 186002 - DNA, 890 bp, Homo sapiens
  Payload ID: 16625
  Gene Symbol: SPNS1
  Gene Name: spinster homolog 1 (Drosophila)
  ENST ID: ENST00000564476
  CDS Start-End: 1-824
cggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgaggatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggtcagttaggagctgtgcccggcccagcttcttgatctgcctgtctgtctgtccatctgtctgcccactcctgtgcacctggcagctcagtccacagccct

SEQ ID NO: 186003 - DNA, 780 bp, Homo sapiens
  Payload ID: 16625
  Gene Symbol: SPNS1
  Gene Name: spinster homolog 1 (Drosophila)
  ENST ID: ENST00000568829
  CDS Start-End: 1-539
ctgtgtttggctacctgggtgacaggtacaatcggaagtatctcatgtgcgggggcattgccttctggtccctggtgacactggggtcatccttcatccccggagagattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacctgggtagctcaggggaggaggtgggggtccaggagggggatccctctccacaggggcagccccaagggctcggtgctatttgtaacggaataaaatttgtagcc

SEQ ID NO: 186004 - DNA, 1615 bp, Homo sapiens
  Payload ID: 16625
  Gene Symbol: SPNS1
  Gene Name: spinster homolog 1 (Drosophila)
  ENST ID: ENST00000566059
  CDS Start-End: 1-1615
caggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgaggccctctgtctcccaggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacctgggtagctcaggggaggaggtgggggtccaggagggggatccctctccacaggggcagccccaagggctcggtgctattt

SEQ ID NO: 186005 - DNA, 829 bp, Homo sapiens
  Payload ID: 16625
  Gene Symbol: SPNS1
  Gene Name: spinster homolog 1 (Drosophila)
  ENST ID: ENST00000567771
  CDS Start-End: 296-829
agtttacaaggctagcagggttggggaatctcaacaaagggcggggcgttgctcaagctccatccgtccgtccgtccatccctccgtccctccaatcctccatccatcgcgctgctcaagctccatccatccatttatccatccatccatccatcctttattgagagtaaaaagccgccaaccagaccctgggaggaagacaggatggttcccgagaactagggctgctccttggcttttagaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctc

SEQ ID NO: 186006 - DNA, 3447 bp, Homo sapiens
  Payload ID: 16626
  Gene Symbol: SPNS2
  Gene Name: spinster homolog 2 (Drosophila)
  Uniprot ID: Q8IVW8
  ENST ID: ENST00000329078
  CDS Start-End: 211-1860
ggggccgggccgcagctgtcagagccgcggcggcgaacgaggcgcagcgagctgagcggtggcagcgccgcagccggggccggagcgcaggagccgacggggcccgaccaggatggtgcagtggcggctccgcggcgcacgcacgcgctgagcgggcccagcctgggccccgcgccccccgcgccccccgccgccccgatccgggccggcatgatgtgcctggaatgcgcctcggcggcggcgggcggcgcggaggaggaggaggcggacgcggagcggcggcgccggcgccggggggcgcagcgaggggctggcggtagcggttgctgcggggcgcggggcgcgggcggcgctggagtctcggccgcgggcgatgaggtgcagacgctgtcgggcagcgtaaggcgggccccgaccggaccccccggcacccccggcacccccggctgcgcagctactgcaaagggccccggcgctcagcagcccaaaccggccagcttgggccgcgggcggggggcagccgccgccatcctcagcttgggcaacgtgctcaactacctggacaggtacaccgtggcaggcgtccttctggacatccagcagcactttggggtcaaggaccgaggcgccggcctgctgcagtcagtgttcatctgtagcttcatggtggctgcccccatcttcggctacctgggcgaccgcttcaacaggaaggtgattctcagctgcggcattttcttctggtcggccgtcaccttctccagctccttcattccccagcagtacttctggctgctggtcctgtcccgggggctggtgggcatcggggaggccagctactccaccatcgcccccactatcattggcgacctcttcaccaagaacacgcgtacgctcatgctgtccgtcttctacttcgccatcccactgggcagtggcctgggctacattactggctccagcgtgaagcaggcagccggagactggcactgggcattgcgggtgtcccctgtcctgggcatgatcacaggaacactcatcctcattctggtcccagccactaaaaggggtcatgccgaccagctcggggaccagctcaaggcccggacctcatggctccgagatatgaaggccctgattcgaaaccgcagctacgtcttctcctccctggccacgtcggctgtctccttcgccacgggggccctgggcatgtggatcccgctctacctgcaccgcgcccaagttgtgcagaagacagcagagacgtgcaacagcccgccctgtggggccaaggacagcctcatctttggggccatcacctgctttacgggatttctgggcgtggtcacgggggcaggagccacgcgctggtgccgcctgaagacccagcgggccgacccactggtgtgtgccgtgggcatgctgggctctgccatcttcatctgcctgatcttcgtggctgccaagagcagcatcgtaggagcctatatctgtatcttcgtcggggagacgctgctgttttctaactgggccatcactgcagacatcctcatgtacgtggtcatccccacgcggcgcgccactgccgtggccttgcagagcttcacctcccacctgctgggggacgccgggagcccctacctcattggctttatctcagacctgatccgccagagcactaaggactccccgctctgggagttcctgagcctgggctacgcgctcatgctctgccctttcgtcgtggtcctgggcggcatgttcttcctcgccactgcgctcttcttcgtcagcgaccgcgccagggctgagcagcaggtgaaccagctggcgatgccgcccgcatctgtgaaagtctgaggtggtgccattgggacaatgaagaacccacactcccacctcgtctgggaggtgtcctacagcgtccgggaccggctgggctgccccaaagctttctgtgtgatccacggctaggcacccaccctctctggcccaggcctgctgagtggccctggcatcaagaagaggctgtgtcctcagttaccctggaaggatgtgtgtgttggagccacacggttggacaggttcccagccctaggtttgggccgcagggcccctggggccaaggaagaagacagccccaagtgggtgtccggggagagcctggcctgccaccagcttatgtgatcttgggcaagtccctgccctccctggaacgaagggccagggggctggactttcccacacaacttgctgggcaaagcacgatctgcagctttgaagactcaacagaccctggaccatacggagagcaggtggcccaggcctcagggcggcagtcccggctttgaggctcacgcgagggcctggtatgcagggaccactgctcagctgggcctcggaccttggggatattggacgcaacctggcaaatgaagctgggcgcccaagtctctgggtactccctggaggacactgtctcactgtctcgggttggctcccagcctggaggtcccagatggggactgttctgacaagctggcatcaccaggggtgaaggccctggctgcagctgtacaccacctgtgcccccaggctcaaggtctctggcaggtgcacaccagcccaactctgcagggcttctctccctgccaccaccccccaagccaggaccccactccttccccgaggctgagctgagccttttccaggggcagggcccaggagaccattcccagaatccatggggcagtagccagggctccggctgctggaggaagcagctatccacaaagcttcctgccccagagctgaggctgaggccccgggagaggcggcccctacccaaacactggctgctggcattccaccaagtgaccccaggggggggccaggccttcgatcacccacctcccatccatgcacacaccaggatgcagctgccaacttcacaccagccccaacccgctttgggggagcttagccccctgcgtcacccactccctgcacttctgctgcaatcaaggtggttctggtgcgggggtggggtggggggtgaggccttgtggccaatgggggaccccccaagagccagcttggacaatgctcttcttgccccttagttactggctggctgtggcttcagtggtgtgtaagcaggtggaatactcacccaccaagctctggggtaccccgagggcctgacaagaggatggggtgggggtggcatcctccaaagaccagcctccacccccactccagcctcagcggggccccagcgatgttttcttgttgtacaagaaccaggtccgagtgttgcctcctcttccttccggaagccaaactgctcctttattttttagagctgctgattgtgaatctcagagtcttaagagagaagccaaatatattcctcttgtaaatgaagaaataaacctatttaaatca

SEQ ID NO: 186007 - DNA, 846 bp, Homo sapiens
  Payload ID: 16626
  Gene Symbol: SPNS2
  Gene Name: spinster homolog 2 (Drosophila)
  ENST ID: ENST00000571386
  CDS Start-End: 1-846
gccctgggcatgtggatcccgctctacctgcaccgcgcccaagttgtgcagaagacagcagagacgtgcaacagcccgccctgtggggccaaggacagcctcatctttggggccatcacctgctttacgggatttctgggcgtggtcacgggggcaggagccacgcgctggtgccgcctgaagacccagcgggccgacccactggtgtgtgccgtgggcatgctgggctctgccatcttcatctgcctgatcttcgtggctgccaagagcagcatcgtaggagcctatatctgtatcttcgtcggggagacgctgctgttttctaactgggccatcactgcagacatcctcatgtacgtggtcatccccacgcggcgcgccactgccgtggccttgcagagcttcacctcccacctgctgggggacgccgggagcccctacctcattggctttggtgaaccagctggcgatgccgcccgcatctgtgaaagtctgaggtggtgccattgggacaatgaagaacccacactcccacctcgtctgggaggtgtcctacagcgtccgggaccggctgggctgccccaaagctttctgtgtgatccacggctaggcacccaccctctctggcccaggcctgctgagtggccctggcatcaagaagaggctgtgtcctcagttaccctggaaggatgtgtgtgttggagccacacggttggacaggttcccagccctaggtttgggccgcagggcccctggggccaaggaagaagacagccccaagtgggtgtccggggagagcctggcctgccaccagcttatgtgatcttgggcaagtccctgccctcc

SEQ ID NO: 186008 - DNA, 2133 bp, Homo sapiens
  Payload ID: 16627
  Gene Symbol: SPNS3
  Gene Name: spinster homolog 3 (Drosophila)
  Uniprot ID: Q6ZMD2
  ENST ID: ENST00000355530
  CDS Start-End: 281-1819
tgaagctgcaggctagatcaaggggaccacagagttgtccagtccccagggtgggggtgccaggagcccttgtcctccgtagcaggtctcagaggctgacgatggggaaatcgcactggtgaagctgccgtggggtcaggaggaacctgcgataagacgcccaacagttagggcaggtgctttgaggtttggagcctgggaccccacaggaagtgacttcgtgctgagctaatgttgcttcatcctggcgccagtctcaggccaagagctgcaggctggcatggctggggggatgtcagcggagtgccctgagcctgggccaggaggtctgcagggccagtccccagggccaggcaggcagtgtccccctcccatcacgcccacctcctggagcctgcccccgtggagggcctacgtggctgccgccgtcctctgctacatcaacctcctgaattacatgaactggttcatcattgcaggagtgctgctggatatacaggaggttttccagatcagtgacaaccatgctggtttgcttcagactgtcttcgttagctgcctgctgctgtctgcacctgtgtttggctacctgggcgaccgacatagccgcaaggctaccatgagcttcggtatcttgctgtggtcaggagctggcctctctagctccttcatctccccccggtattcttggctcttcttcctgtcccggggcatcgtgggcactggctcggccagctactccaccatcgcgcccaccgtcctgggcgacctcttcgtgagggaccagcgcacccgcgtgctggctgtcttctacatctttatccccgttggaagtggtctgggctacgtgctggggtcggctgtgacgatgctgactgggaactggcgctgggccctccgagtcatgccctgcctggaggccgtggccttgatcctgcttatcctgctggttccagacccaccccggggagctgccgagacacagggggagggggccgtgggaggcttcaggagcagctggtgtgaggacgtcagatacctggggaaaaactggagtttcgtgtggtcgaccctcggagtgaccgccatggcctttgtgactggagccctggggttctgggcccccaagtttctgctcgaggcacgcgtggttcacgggctgcagcctccctgcttccaggagccgtgcagcaaccccgacagcctgatttttggggcactgaccatcatgaccggcgtcattggggtcatcttgggggcagaagctgcgaggaggtacaagaaagtcattccaggagctgagcccctcatctgcgcctccagcctgcttgccacagccccctgcctctacctggctctcgtcctggccccgaccaccctgctggcctcctatgtgttcctgggccttggggagctgcttctgtcctgcaactgggcagtggttgccgacatcctgctgtctgtggtggtgcccagatgccgggggacggcagaggcacttcagatcacggtgggccacatcctgggagacgctggcagcccctatctcacaggacttatctctagtgtcctgcgggccaggcgccctgactcctatctgcagcgcttccgcagcctgcagcagagcttcctgtgctgcgcctttgtcatcgccctggggggcggctgcttcctgctgactgcgctgtacctggagagagacgagacccgggcctggcagcctgtcacagggaccccagacagcaatgatgtggacagcaacgacctggagagacaaggcctactttcgggcgctggcgcctctacagaggagccctgaggtccctgcctacactcgtcctgcctgcaagcctcccgttggtccccacagcagcagtgcctcggttcctctttggctgtcctcggggactccggctgaggcacatctgccacttttgaattcccggctggagagctggcaggaccctgtggctgggctgggaatggagctgtcagcactctgcgtgggaggcctgggcctgtgcctgcatcccgctcaaggctgccccagcctggggtctccagcctggctgctgctgggccctgaataaagagaggccagtacaaagcccatggattttgggcctgtagaca

SEQ ID NO: 186009 - DNA, 1721 bp, Homo sapiens
  Payload ID: 16627
  Gene Symbol: SPNS3
  Gene Name: spinster homolog 3 (Drosophila)
  ENST ID: ENST00000575194
  CDS Start-End: 6-614
ctggcatggctggggggatgtcagcggagtgccctgagcctgggccaggaggtctgcagggccagtccccagggccaggcaggcagtgtccccctcccatcacgcccacctcctggagcctgcccccgtggagggcctacgtggctgccgccgtcctctgctacatcaacctcctgaattacatgaactggttcatcattgcaggagtgctgctggatatacaggaggttttccagatcagtgacaaccatgctggtttgcttcagactgtattcttggctcttcttcctgtcccggggcatcgtgggcactggctcggccagctactccaccatcgcgcccaccgtcctgggcgacctcttcgtgagggaccagcgcacccgcgtgctggctgtcttctacatctttatccccgttggaagtggtctgggctacgtgctggggtcggctgtgacgatgctgactgggaactggcgctgggccctccgagtcatgccctgcctggaggccgtggccttgatcctgcttatcctgctggttccagacccaccccggggagctgccgagacacagggggagggggccgtgggaggcttcaggagcagctggtgtgaggacgtcagatacctggggaaaaactggagtttcgtgtggtcgaccctcggagtgaccgccatggcctttgtgactggagccctggggttctgggcccccaagtttctgctcgaggcacgcgtggttcacgggctgcagcctccctgcttccaggagccgtgcagcaaccccgacagcctgatttttggggcactgaccatcatgaccggcgtcattggggtcatcttgggggcagaagctgcgaggaggtacaagaaagtcattccaggagctgagcccctcatctgcgcctccagcctgcttgccacagccccctgcctctacctggctctcgtcctggccccgaccaccctgctggcctcctatgtgttcctgggccttggggagctgcttctgtcctgcaactgggcagtggttgccgacatcctgctgtctgtggtggtgcccagatgccgggggacggcagaggcacttcagatcacggtgggccacatcctgggagacgctggcagcccctatctcacaggacttatctctagtgtcctgcgggccaggcgccctgactcctatctgcagcgcttccgcagcctgcagcagagcttcctgtgctgcgcctttgtcatcgccctggggggcggctgcttcctgctgactgcgctgtacctggagagagacgagacccgggcctggcagcctgtcacagggaccccagacagcaatgatgtggacagcaacgacctggagagacaaggcctactttcgggcgctggcgcctctacagaggagccctgaggtccctgcctacactcgtcctgcctgcaagcctcccgttggtccccacagcagcagtgcctcggttcctctttggctgtcctcggggactccggctgaggcacatctgccacttttgaattcccggctggagagctggcaggaccctgtggctgggctgggaatggagctgtcagcactctgcgtgggaggcctgggcctgtgcctgcatcccgctcaaggctgccccagcctggggtctccagcctggctgctgctgggccctgaataaagagaggccagtacaaagcccatggattttgggcctgtagaca

SEQ ID NO: 186010 - DNA, 1877 bp, Homo sapiens
  Payload ID: 16628
  Gene Symbol: SPIRE1
  Gene Name: spire-type actin nucleation factor 1
  ENST ID: ENST00000309836
  CDS Start-End: 106-1743
actcagatgctcattgaagaggaggaggaggttgagaaaaggtttctcccatcagtttttatctaattcattcttttgagaggtaaattgggatattcacaatgtatggaaacagagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaagagtgctcatgaaatcatcctcgacttcatcagatccagacctcctttaaatccagtctcagccagaaaactgaaaccaactccaccacggccacggagcctccatgaaagaatattagaagaaattaaagcagaaagaaagctgcggcctgtatcaccagaggagattagacgtagcagattagatgtgactacccctgaatctacaaagaatcttgtggagtcatctatggtgaatggaggtttgacatcacaaacaaaagaaaacgggttaagtacctcacagcaggtgcctgcacagcggaagaagctcctcagagccccaactctggccgaactggacagctctgagtctgaggaagaaacgctgcacaagtcgaccagcagcagcagcgtgtctccctctttccctgaagagccagtcctggaggccgtgtccacaaggaagaagcctccaaaattcctgcccatatcatcaacaccccagccagagagacggcagccaccccagagacgacattccattgaaaaggaaacgcctactaacgtgaggcagttcctgccgccttccaggcagagttcccgctctcttgaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagaggccggtgtgctcacagtgttgcaaaaagatgcggctgccctccaaaccatactccactcttcctatcttttcattgggaccttctgctctgcaaagaggggaaagtagtatgaggtcagaaaaaccctccactgcccatcatcggccacttcggagcattgccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgcccttcagagaggacgatcagtgagatctgagcctcgtgcctttcagctgcttttgtgctacgagtcagcgtccgtgcgcgaggacactgagccgggctggctctcctttctgtggttttatttaatgggcttgaatttgcattagatcagatttttgccgcatc

SEQ ID NO: 186011 - DNA, 5533 bp, Homo sapiens
  Payload ID: 16628
  Gene Symbol: SPIRE1
  Gene Name: spire-type actin nucleation factor 1
  Uniprot ID: Q08AE8
  ENST ID: ENST00000410092
  CDS Start-End: 180-2408
cgccctcctcttgcccacgcctcccgggcactcgcctggtcccggcggcggcgcgcgcggccgcgttgggcggcggcggttccggggatggtgaggcggcggcgcgcgacgacgatgctccggagctgaggagacgccggcacacggcgcgactgccgagcgcagcgcccacccgcgggatggctcaggcggctggcccggcgggcggcggggagccgcggactgaggcagtgggcggcgaggggccgcgggagcccggggcagccggcggcgcggccgggggctcccgggacgcgctgagcctggaggagatcctgcggctgtacaaccagcccatcaacgaggagcaggcgtgggccgtgtgctaccagtgctgcggttccctgcgcgccgccgcccgccgccgccagccccgccaccgtgtgcgctcggccgcgcagatccgcgtctggagggacggcgccgtcaccctggcgcccgcggccgacgacgcgggagagccgcccccagttgcgggtaaattgggatattcacaatgtatggaaacagaggtcattgaatctttgggaattattatttataaagcactggactatggtttgaaggagaatgaagaaagggaattaagccctcccctagagcagcttatcgatcacatggccaacacggtggaagctgacggtagcaatgatgagggctatgaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaagagtgctcatgaaatcatcctcgacttcatcagatccagacctcctttaaatccagtctcagccagaaaactgaaaccaactccaccacggccacggagcctccatgaaagaatattagaagaaattaaagcagaaagaaagctgcggcctgtatcaccagaggagattagacgtagcagattagatgtgactacccctgaatctacaaagaatcttgtggagtcatctatggtgaatggaggtttgacatcacaaacaaaagaaaacgggttaagtacctcacagcaggtgcctgcacagcggaagaagctcctcagagccccaactctggccgaactggacagctctgagtctgaggaagaaacgctgcacaagtcgaccagcagcagcagcgtgtctccctctttccctgaagagccagtcctggaggccgtgtccacaaggaagaagcctccaaaattcctgcccatatcatcaacaccccagccagagagacggcagccaccccagagacgacattccattgaaaaggaaacgcctactaacgtgaggcagttcctgccgccttccaggcagagttcccgctctcttgaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagaggccggtgtgctcacagtgttgcaaaaagatgcggctgccctccaaaccatactccactcttcctatcttttcattgggaccttctgctctgcaaagaggggaaagtagtatgaggtcagaaaaaccctccactgcccatcatcggccacttcggagcattgccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgcccttcagagaggacgatcagtgagatctgagcctcgtgcctttcagctgcttttgtgctacgagtcagcgtccgtgcgcgaggacactgagccgggctggctctcctttctgtggttttatttaatgggcttgaatttgcattagatcagatttttgccgcatcacattgttccacagactgaatgctgtgttcgtatcgattgatgaaacgtgacaggtccgccaattgctcgtttgcactgagagaggacaacagtttgaaacttacttttgtgtgtgtgtggctttggaagccagtagctacttccttagttcagttctttactgttcctcgaataatctcctgactaaggcaaaaaaaaaaagcttctcctacgagaatcagtctaacagagatgccgatgtcagcacagccctaagcagtaagtcatattggcatttccacgtgactgtgtttctatcccgtgtacagagagatccagagccctacactccacgacctgggggctcacagcacagaacctagaagcacctgctgacactcttcaactgatttttaaatgttgttgcttggagataaaaattacataagggactttttgcctgcattctagtgcaaaacatctgaagagctgtacacccacaagggtgactatttcccctgagtggccgtgttgtcccagtgccctggttcagtgtctcctgagtggatgacaggtcttcattctctatcttgaatgtattatggttactaatagttttataatggaggtctaagaattaaagttgtgtgggagtttcaggacaaaggaaggctaaaagtttgtcaagacgttgagcgtattttggttacctatgagaagggttgtgacagtgtacagtggcagctgttggccacgctgcagaaatgagctggagctcatgggttttcagctacatttttcataactttgtagtacatccatcttgagtaaattaagccacaatttggtacctagggtctcaaactaaaatttatttttataaatgaattttaaaagaaaaaatatctacttcttttaaagttagaagaaaattaacctgctgacaggcaacatttttggggtgctttctgcactagttttccttgtaaatgatttgagtgagtaggtttggtttctgacgaaagtagactggagggtagcattgtatgcctcaaatgtctcagtgtgtttggctcatacgtgggctatactgtattattttggtatgcttacaaatgactaaccaatcaaattgtcattaatgtttggaaaatctgttaatgcacatgcacaataatttcctgaaagccataggacatgtctgtagtcagcaccacgatagcaccgtttcatgaaaggcatggcggctgcatttcataccacatcaaaatacagtaacatttctatactaaattaacagtaatacctcaaaactgctccggtagtagtttttaatggattgaaatttacagtttagtaaaaggcttaaaattacttatacttatgaaataaactttaccagttgactaaaataatgcatgttaacagttggtctgtatttgcatgtaaaagtgggccaccagagaacccttattgattacttaagtgtttacattattttaaagactcctgtttaagagctttcagaattgtactgggtgaatctcatttataaaacttcctaagagactatctgaactctatactccagacagttaggtgggagtataaatctaccccttttgatgaccccaggcttgagtttttaaaatgactacccagaagggcacaagggggaaggaaatggtatttgtatatgtatataaatatgcacctaggagaatgtgctttttaaaataatgactactgtttttattaaaacataagaaactacacccccaaaataagactttcattcacattcacaaagcaaacatctagtacatgtctttcacttcactttatgatagtgtattggatgatttgggcattacgatcacctcttaccacagcacagaacatacattcttcaacagcattaacggagtttgccaagtgcattaaagaggtcacgtggagggtacgttcatatgaaacaatctgcagaaagtggggtaagaaagggcacatggcacagttaaagttgtagaaatcaaattactatcattttttgttgccaaaacaaagtcttacatttaacccccctttctaccacccccctccacacttcacgtcagctacatagtttccacagggtaattcactaagagcttgtggagcttggttttaaaatccttagcctggtctgactttaggcatagcttccagttcttccttccgtgtcctggtttcttgttcagttttacttctaatccaacaacaaaagaaatgtctggctggtctcagctagagtctgatgtgtcttagagcatgtgtgcgtatctgaaccatcatccctgctctcatctcagctccctccaggcctgagcaccggttccttttgtcccatacgtcatgaagtcacactattgggaaacctgtgcttccctctccatggcttaactccctgtcagtgtcggagtgtataagaatgcttgtaaatactgtaatatatttattaatatttgaaaggcattcattcagtggacagtgggaattaactctcccaaggcaagtgaaaatgaatgattgacgtacgttgatttaacaatcttactagattttaattcttaaggatttcaaatgaaaccagaaggtggttatgtaagaggcttaaaatgatcttatgtttaaagagattctgttattagcaccatgaactcgtactatgaaatttttaagccttttatttttctaactatattactgtaggactggatattaggtgtcatataggaaacacaaaagtttattgctgtttgctaaagcaaaatagcagaaaattttgtatatgcaaaactgttgaaggaccatagagaaatgtgtactactgacggggcttttactaggcttcctgcgtgtgtaaaagtcgaggtattgctggcattcagggtgacatgatggtactaaatgttttccattaaagtcttctattttaaaatttagagaaaaataaaatggctttccatcag

SEQ ID NO: 186012 - DNA, 5665 bp, Homo sapiens
  Payload ID: 16628
  Gene Symbol: SPIRE1
  Gene Name: spire-type actin nucleation factor 1
  Uniprot ID: Q08AE8
  ENST ID: ENST00000409402
  CDS Start-End: 269-2539
aggcggggcggggcggggcggggcgccggacgccatcgcgtcgctaccggccggcggctgtctgaccgggactgcagccgtgtcctcgccgccctcctcttgcccacgcctcccgggcactcgcctggtcccggcggcggcgcgcgcggccgcgttgggcggcggcggttccggggatggtgaggcggcggcgcgcgacgacgatgctccggagctgaggagacgccggcacacggcgcgactgccgagcgcagcgcccacccgcgggatggctcaggcggctggcccggcgggcggcggggagccgcggactgaggcagtgggcggcgaggggccgcgggagcccggggcagccggcggcgcggccgggggctcccgggacgcgctgagcctggaggagatcctgcggctgtacaaccagcccatcaacgaggagcaggcgtgggccgtgtgctaccagtgctgcggttccctgcgcgccgccgcccgccgccgccagccccgccaccgtgtgcgctcggccgcgcagatccgcgtctggagggacggcgccgtcaccctggcgcccgcggccgacgacgcgggagagccgcccccagttgcgggtaaattgggatattcacaatgtatggaaacagaggtcattgaatctttgggaattattatttataaagcactggactatggtttgaaggagaatgaagaaagggaattaagccctcccctagagcagcttatcgatcacatggccaacacggtggaagctgacggtagcaatgatgagggctatgaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaagagtgctcatgaaatcatcctcgacttcatcagatccagacctcctttaaatccagtctcagccagaaaactgaaaccaactccaccacggccacggagcctccatgaaagaatattagaagaaattaaagcagaaagaaagctgcggcctgtatcaccagaggagattagacgtagcagattagcaatgcggccacttagcatgtcttacagttttgacttgtcagatgtgactacccctgaatctacaaagaatcttgtggagtcatctatggtgaatggaggtttgacatcacaaacaaaagaaaacgggttaagtacctcacagcaggtgcctgcacagcggaagaagctcctcagagccccaactctggccgaactggacagctctgagtctgaggaagaaacgctgcacaagtcgaccagcagcagcagcgtgtctccctctttccctgaagagccagtcctggaggccgtgtccacaaggaagaagcctccaaaattcctgcccatatcatcaacaccccagccagagagacggcagccaccccagagacgacattccattgaaaaggaaacgcctactaacgtgaggcagttcctgccgccttccaggcagagttcccgctctcttgaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagaggccggtgtgctcacagtgttgcaaaaagatgcggctgccctccaaaccatactccactcttcctatcttttcattgggaccttctgctctgcaaagaggggaaagtagtatgaggtcagaaaaaccctccactgcccatcatcggccacttcggagcattgccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgcccttcagagaggacgatcagtgagatctgagcctcgtgcctttcagctgcttttgtgctacgagtcagcgtccgtgcgcgaggacactgagccgggctggctctcctttctgtggttttatttaatgggcttgaatttgcattagatcagatttttgccgcatcacattgttccacagactgaatgctgtgttcgtatcgattgatgaaacgtgacaggtccgccaattgctcgtttgcactgagagaggacaacagtttgaaacttacttttgtgtgtgtgtggctttggaagccagtagctacttccttagttcagttctttactgttcctcgaataatctcctgactaaggcaaaaaaaaaaagcttctcctacgagaatcagtctaacagagatgccgatgtcagcacagccctaagcagtaagtcatattggcatttccacgtgactgtgtttctatcccgtgtacagagagatccagagccctacactccacgacctgggggctcacagcacagaacctagaagcacctgctgacactcttcaactgatttttaaatgttgttgcttggagataaaaattacataagggactttttgcctgcattctagtgcaaaacatctgaagagctgtacacccacaagggtgactatttcccctgagtggccgtgttgtcccagtgccctggttcagtgtctcctgagtggatgacaggtcttcattctctatcttgaatgtattatggttactaatagttttataatggaggtctaagaattaaagttgtgtgggagtttcaggacaaaggaaggctaaaagtttgtcaagacgttgagcgtattttggttacctatgagaagggttgtgacagtgtacagtggcagctgttggccacgctgcagaaatgagctggagctcatgggttttcagctacatttttcataactttgtagtacatccatcttgagtaaattaagccacaatttggtacctagggtctcaaactaaaatttatttttataaatgaattttaaaagaaaaaatatctacttcttttaaagttagaagaaaattaacctgctgacaggcaacatttttggggtgctttctgcactagttttccttgtaaatgatttgagtgagtaggtttggtttctgacgaaagtagactggagggtagcattgtatgcctcaaatgtctcagtgtgtttggctcatacgtgggctatactgtattattttggtatgcttacaaatgactaaccaatcaaattgtcattaatgtttggaaaatctgttaatgcacatgcacaataatttcctgaaagccataggacatgtctgtagtcagcaccacgatagcaccgtttcatgaaaggcatggcggctgcatttcataccacatcaaaatacagtaacatttctatactaaattaacagtaatacctcaaaactgctccggtagtagtttttaatggattgaaatttacagtttagtaaaaggcttaaaattacttatacttatgaaataaactttaccagttgactaaaataatgcatgttaacagttggtctgtatttgcatgtaaaagtgggccaccagagaacccttattgattacttaagtgtttacattattttaaagactcctgtttaagagctttcagaattgtactgggtgaatctcatttataaaacttcctaagagactatctgaactctatactccagacagttaggtgggagtataaatctaccccttttgatgaccccaggcttgagtttttaaaatgactacccagaagggcacaagggggaaggaaatggtatttgtatatgtatataaatatgcacctaggagaatgtgctttttaaaataatgactactgtttttattaaaacataagaaactacacccccaaaataagactttcattcacattcacaaagcaaacatctagtacatgtctttcacttcactttatgatagtgtattggatgatttgggcattacgatcacctcttaccacagcacagaacatacattcttcaacagcattaacggagtttgccaagtgcattaaagaggtcacgtggagggtacgttcatatgaaacaatctgcagaaagtggggtaagaaagggcacatggcacagttaaagttgtagaaatcaaattactatcattttttgttgccaaaacaaagtcttacatttaacccccctttctaccacccccctccacacttcacgtcagctacatagtttccacagggtaattcactaagagcttgtggagcttggttttaaaatccttagcctggtctgactttaggcatagcttccagttcttccttccgtgtcctggtttcttgttcagttttacttctaatccaacaacaaaagaaatgtctggctggtctcagctagagtctgatgtgtcttagagcatgtgtgcgtatctgaaccatcatccctgctctcatctcagctccctccaggcctgagcaccggttccttttgtcccatacgtcatgaagtcacactattgggaaacctgtgcttccctctccatggcttaactccctgtcagtgtcggagtgtataagaatgcttgtaaatactgtaatatatttattaatatttgaaaggcattcattcagtggacagtgggaattaactctcccaaggcaagtgaaaatgaatgattgacgtacgttgatttaacaatcttactagattttaattcttaaggatttcaaatgaaaccagaaggtggttatgtaagaggcttaaaatgatcttatgtttaaagagattctgttattagcaccatgaactcgtactatgaaatttttaagccttttatttttctaactatattactgtaggactggatattaggtgtcatataggaaacacaaaagtttattgctgtttgctaaagcaaaatagcagaaaattttgtatatgcaaaactgttgaaggaccatagagaaatgtgtactactgacggggcttttactaggcttcctgcgtgtgtaaaagtcgaggtattgctggcattcagggtgacatgatggtactaaatgttttccattaaagtcttctattttaaaatttagagaaaaataaaatggctttccatcaga

SEQ ID NO: 186013 - DNA, 701 bp, Homo sapiens
  Payload ID: 16628
  Gene Symbol: SPIRE1
  Gene Name: spire-type actin nucleation factor 1
  ENST ID: ENST00000449797
  CDS Start-End: 109-701
atcccagttgagaaccactgctctagcaggtggtgcccaggattgtgttcagggtagagaagtggattctggctgtaatcctcaagtaaattgggatattcacaatgtatggaaacagaggtcattgaatctttgggaattattatttataaagcactggactatggtttgaaggagaatgaagaaagggaattaagccctcccctagagcagcttatcgatcacatggccaacacggtggaagctgacggtagcaatgatgagggctatgaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagata

SEQ ID NO: 186014 - DNA, 2109 bp, Homo sapiens
  Payload ID: 16628
  Gene Symbol: SPIRE1
  Gene Name: spire-type actin nucleation factor 1
  Uniprot ID: Q08AE8
  ENST ID: ENST00000440472
  CDS Start-End: 202-1578
gtgggctaggtgtgagggtaaattgggatattcacaatgtatggaaacagagcctatttaatagcagtaaataacatatgaaagccactattaactgtcattgaatctttgggaattattatttataaagcactggactatggtttgaaggagaatgaagaaagggaattaagccctcccctagagcagcttatcgatcacatggccaacacggtggaagctgacggtagcaatgatgagggctatgaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaagagtgctcatgaaatcatcctcgacttcatcagatccagacctcctttaaatccagtctcagccagaaaactgaaaccaactccaccacggccacggagcctccatgaaagaatattagaagaaattaaagcagaaagaaagctgcggcctgtatcaccagaggagattagacgtagcagattagatgtgactacccctgaatctacaaagaatcttgtggagtcatctatggtgaatggaggtttgacatcacaaacaaaagaaaacgggttaagtacctcacagcaggtgcctgcacagcggaagaagctcctcagagccccaactctggccgaactggacagctctgagtctgaggaagaaacgctgcacaagtcgaccagcagcagcagcgtgtctccctctttccctgaagagccagtcctggaggccgtgtccacaaggaagaagcctccaaaattcctgcccatatcatcaacaccccagccagagagacggcagccaccccagagacgacattccattgaaaaggaaacgcctactaacgtgaggcagttcctgccgccttccaggcagagttcccgctctcttgaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagagtgactgcctctttaacggtactgctcattgccagttttatttgggataatagatgcggctgccctccaaaccatactccactcttcctatcttttcattgggaccttctgctctgcaaagaggggaaagtagtatgaggtcagaaaaaccctccactgcccatcatcggccacttcggagcattgccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgcccttcagagaggacgatcagtgagatctgagcctcgtgcctttcagctgcttttgtgctacgagtcagcgtccgtgcgcgaggacactgagccgggctggctctcctttctgtggttttatttaatgggcttgaatttgcattagatcagatttttgccgca

SEQ ID NO: 186015 - DNA, 2107 bp, Homo sapiens
  Payload ID: 16628
  Gene Symbol: SPIRE1
  Gene Name: spire-type actin nucleation factor 1
  Uniprot ID: Q08AE8
  ENST ID: ENST00000453447
  CDS Start-End: 110-1978
gtttactcagatgctcattgaagaggaggaggaggttgagaaaaggtttctcccatcagtttttatctaattcattcttttgagaggtaaattgggatattcacaatgtatggaaacagaggtcattgaatctttgggaattattatttataaagcactggactatggtttgaaggagaatgaagaaagggaattaagccctcccctagagcagcttatcgatcacatggccaacacggtggaagctgacggtagcaatgatgagggctatgaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaagagtgctcatgaaatcatcctcgacttcatcagatccagacctcctttaaatccagtctcagccagaaaactgaaaccaactccaccacggccacggagcctccatgaaagaatattagaagaaattaaagcagaaagaaagctgcggcctgtatcaccagaggagattagacgtagcagattagatgtgactacccctgaatctacaaagaatcttgtggagtcatctatggtgaatggaggtttgacatcacaaacaaaagaaaacgggttaagtacctcacagcaggtgcctgcacagcggaagaagctcctcagagccccaactctggccgaactggacagctctgagtctgaggaagaaacgctgcacaagtcgaccagcagcagcagcgtgtctccctctttccctgaagagccagtcctggaggccgtgtccacaaggaagaagcctccaaaattcctgcccatatcatcaacaccccagccagagagacggcagccaccccagagacgacattccattgaaaaggaaacgcctactaacgtgaggcagttcctgccgccttccaggcagagttcccgctctcttgaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagaggccggtgtgctcacagtgttgcaaaaagatgcggctgccctccaaaccatactccactcttcctatcttttcattgggaccttctgctctgcaaagaggggaaagtagtatgaggtcagaaaaaccctccactgcccatcatcggccacttcggagcattgccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgcccttcagagaggacgatcagtgagatctgagcctcgtgcctttcagctgcttttgtgctacgagtcagcgtccgtgcgcgaggacactgagccgggctggctctcctttctgtggttttatttaatgggcttgaatttgcattagatcagatttttgcc

SEQ ID NO: 186016 - DNA, 863 bp, Homo sapiens
  Payload ID: 16628
  Gene Symbol: SPIRE1
  Gene Name: spire-type actin nucleation factor 1
  ENST ID: ENST00000592156
  CDS Start-End: 1-367
ggatgacattcgctgcaaaagatacaccttgcgaaaagtgatggtgaatggtgatattccccctcggttaaaaaagagtgctcatgaaatcatcctcgacttcatcagatccagacctcctttaaatccagtctcagccagaaaactgaaaccaactccaccacggccacggagcctccatgaaagaatattagaagaaattaaagcagaaagaaagctgcggcctgtatcaccagaggagattagacgtagcagattaggaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagaggccggtgtgctcacagtgttgcaaaaagatgcggctgccctccaaaccatactccactcttcctatcttttcattgggaccttctgctctgcaaagaggggaaagtagtatgaggtcagaaaaaccctccactgcccatcatcggccacttcggagcattgccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgc

SEQ ID NO: 186017 - DNA, 546 bp, Homo sapiens
  Payload ID: 16628
  Gene Symbol: SPIRE1
  Gene Name: spire-type actin nucleation factor 1
  ENST ID: ENST00000497844
  CDS Start-End: 105-546
agatgctcattgaagaggaggaggaggttgagaaaaggtttctcccatcagtttttatctaattcattcttttgagaggattggggcataagtgaggataatatatgtcaagtggcaagacttgctgtatagcaggtaaattgggatattcacaatgtatggaaacagaggtcattgaatctttgggaattattatttataaagcactggactatggtttgaaggagaatgaagaaagggaattaagccctcccctagagcagcttatcgatcacatggccaacacggtggaagctgacggtagcaatgatgagggctatgaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaag

SEQ ID NO: 186018 - DNA, 536 bp, Homo sapiens
  Payload ID: 16628
  Gene Symbol: SPIRE1
  Gene Name: spire-type actin nucleation factor 1
  ENST ID: ENST00000462226
  CDS Start-End: 170-536
attgaagaggaggaggaggttgagaaaaggtttctcccatcagtttttatctaattcattcttttgagaggcaagtctattaaaaacatagaaaaacaatctaccctcacttttagaaagttgatggaaatgtcaaaatgcttaaggtaaattgggatattcacaatgtatggaaacagaggtcattgaatctttgggaattattatttataaagcactggactatggtttgaaggagaatgaagaaagggaattaagccctcccctagagcagcttatcgatcacatggccaacacggtggaagctgacggtagcaatgatgagggctatgaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaag

SEQ ID NO: 186019 - DNA, 4995 bp, Homo sapiens
  Payload ID: 16628
  Gene Symbol: SPIRE1
  Gene Name: spire-type actin nucleation factor 1
  ENST ID: ENST00000626255
  CDS Start-End: 1-1869
atggaactagaggtcattgaatctttgggaattattatttataaagcactggactatggtttgaaggagaatgaagaaagggaattaagccctcccctagagcagcttatcgatcacatggccaacacggtggaagctgacggtagcaatgatgagggctatgaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaagagtgctcatgaaatcatcctcgacttcatcagatccagacctcctttaaatccagtctcagccagaaaactgaaaccaactccaccacggccacggagcctccatgaaagaatattagaagaaattaaagcagaaagaaagctgcggcctgtatcaccagaggagattagacgtagcagattagatgtgactacccctgaatctacaaagaatcttgtggagtcatctatggtgaatggaggtttgacatcacaaacaaaagaaaacgggttaagtacctcacagcaggtgcctgcacagcggaagaagctcctcagagccccaactctggccgaactggacagctctgagtctgaggaagaaacgctgcacaagtcgaccagcagcagcagcgtgtctccctctttccctgaagagccagtcctggaggccgtgtccacaaggaagaagcctccaaaattcctgcccatatcatcaacaccccagccagagagacggcagccaccccagagacgacattccattgaaaaggaaacgcctactaacgtgaggcagttcctgccgccttccaggcagagttcccgctctcttgaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagaggccggtgtgctcacagtgttgcaaaaagatgcggctgccctccaaaccatactccactcttcctatcttttcattgggaccttctgctctgcaaagaggggaaagtagtatgaggtcagaaaaaccctccactgcccatcatcggccacttcggagcattgccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgcccttcagagaggacgatcagtgagatctgagcctcgtgcctttcagctgcttttgtgctacgagtcagcgtccgtgcgcgaggacactgagccgggctggctctcctttctgtggttttatttaatgggcttgaatttgcattagatcagatttttgccgcatcacattgttccacagactgaatgctgtgttcgtatcgattgatgaaacgtgacaggtccgccaattgctcgtttgcactgagagaggacaacagtttgaaacttacttttgtgtgtgtgtggctttggaagccagtagctacttccttagttcagttctttactgttcctcgaataatctcctgactaaggcaaaaaaaaaaagcttctcctacgagaatcagtctaacagagatgccgatgtcagcacagccctaagcagtaagtcatattggcatttccacgtgactgtgtttctatcccgtgtacagagagatccagagccctacactccacgacctgggggctcacagcacagaacctagaagcacctgctgacactcttcaactgatttttaaatgttgttgcttggagataaaaattacataagggactttttgcctgcattctagtgcaaaacatctgaagagctgtacacccacaagggtgactatttcccctgagtggccgtgttgtcccagtgccctggttcagtgtctcctgagtggatgacaggtcttcattctctatcttgaatgtattatggttactaatagttttataatggaggtctaagaattaaagttgtgtgggagtttcaggacaaaggaaggctaaaagtttgtcaagacgttgagcgtattttggttacctatgagaagggttgtgacagtgtacagtggcagctgttggccacgctgcagaaatgagctggagctcatgggttttcagctacatttttcataactttgtagtacatccatcttgagtaaattaagccacaatttggtacctagggtctcaaactaaaatttatttttataaatgaattttaaaagaaaaaatatctacttcttttaaagttagaagaaaattaacctgctgacaggcaacatttttggggtgctttctgcactagttttccttgtaaatgatttgagtgagtaggtttggtttctgacgaaagtagactggagggtagcattgtatgcctcaaatgtctcagtgtgtttggctcatacgtgggctatactgtattattttggtatgcttacaaatgactaaccaatcaaattgtcattaatgtttggaaaatctgttaatgcacatgcacaataatttcctgaaagccataggacatgtctgtagtcagcaccacgatagcaccgtttcatgaaaggcatggcggctgcatttcataccacatcaaaatacagtaacatttctatactaaattaacagtaatacctcaaaactgctccggtagtagtttttaatggattgaaatttacagtttagtaaaaggcttaaaattacttatacttatgaaataaactttaccagttgactaaaataatgcatgttaacagttggtctgtatttgcatgtaaaagtgggccaccagagaacccttattgattacttaagtgtttacattattttaaagactcctgtttaagagctttcagaattgtactgggtgaatctcatttataaaacttcctaagagactatctgaactctatactccagacagttaggtgggagtataaatctaccccttttgatgaccccaggcttgagtttttaaaatgactacccagaagggcacaagggggaaggaaatggtatttgtatatgtatataaatatgcacctaggagaatgtgctttttaaaataatgactactgtttttattaaaacataagaaactacacccccaaaataagactttcattcacattcacaaagcaaacatctagtacatgtctttcacttcactttatgatagtgtattggatgatttgggcattacgatcacctcttaccacagcacagaacatacattcttcaacagcattaacggagtttgccaagtgcattaaagaggtcacgtggagggtacgttcatatgaaacaatctgcagaaagtggggtaagaaagggcacatggcacagttaaagttgtagaaatcaaattactatcattttttgttgccaaaacaaagtcttacatttaacccccctttctaccacccccctccacacttcacgtcagctacatagtttccacagggtaattcactaagagcttgtggagcttggttttaaaatccttagcctggtctgactttaggcatagcttccagttcttccttccgtgtcctggtttcttgttcagttttacttctaatccaacaacaaaagaaatgtctggctggtctcagctagagtctgatgtgtcttagagcatgtgtgcgtatctgaaccatcatccctgctctcatctcagctccctccaggcctgagcaccggttccttttgtcccatacgtcatgaagtcacactattgggaaacctgtgcttccctctccatggcttaactccctgtcagtgtcggagtgtataagaatgcttgtaaatactgtaatatatttattaatatttgaaaggcattcattcagtggacagtgggaattaactctcccaaggcaagtgaaaatgaatgattgacgtacgttgatttaacaatcttactagattttaattcttaaggatttcaaatgaaaccagaaggtggttatgtaagaggcttaaaatgatcttatgtttaaagagattctgttattagcaccatgaactcgtactatgaaatttttaagccttttatttttctaactatattactgtaggactggatattaggtgtcatataggaaacacaaaagtttattgctgtttgctaaagcaaaatagcagaaaattttgtatatgcaaaactgttgaaggaccatagagaaatgtgtactactgacggggcttttactaggcttcctgcgtgtgtaaaagtcgaggtattgctggcattcagggtgacatgatggtactaaatgttttccattaaagtcttctattttaaaatttagagaaaaataaaatggctttccatcaga

SEQ ID NO: 186020 - DNA, 3235 bp, Homo sapiens
  Payload ID: 16629
  Gene Symbol: SPIRE2
  Gene Name: spire-type actin nucleation factor 2
  Uniprot ID: Q8WWL2
  ENST ID: ENST00000378247
  CDS Start-End: 44-2188
atggacgcgggtccggcgcgcgggaggcgatgacggccccgccatggcccgggcgggcagctgcggcggcgccgcggcgggcgcagggcggccggagccctgggagctgtccctggaggaggtgctgaaggcctacgagcagccgctcaacgaggagcaggcgtgggccgtgtgcttccagggctgccgcgggctgcggggctcgccgggccggcgcctgcgggataccggggacctcctgctgcgcggggacggctcggtcggggcgcgggagcccgaggccgcggaacctgcaaccatggtcgtgccactagccagctcggaagcccagaccgtgcagtccctcggcttcgccatctaccgcgcgctggactgggggctggacgagagcgaggagcgcgaactcagccctcagctggagcggctcatcgacctcatggccaacaacgacagcgaggacagcggctgcggtgccgccgatgagggctacgggggtcccgaggaggaggaggaggccgagggcgtcccccgcagcgtgcgcacctttgcccaggccatgcggctgtgcgcggcgcggctgaccgacccccggggcgcacaggcgcattaccaggccgtgtgccgcgcgctcttcgtggagacgctggagctgcgggccttcctggccagggtccgggaggccaaggagatgctgcagaagcttcgggaggacgagccgcatctggagacgcctcgggcagagctggacagcctgggtcacacagactgggcccgactgtgggttcagctcatgcgggagctccgccgcggagtgaagctgaagaaggtgcaagagcaggagttcaaccccctccccaccgagttccagctcacgcccttcgagatgctgatgcaggacatccgggcccggaactacaagctgcgcaaggtcatggtggatggggacatcccgccccgggtgaagaaggacgctcacgagctcatcctggactttatccgctcacggcctccactgaagcaggtctctgagaggcggctgcgcccgttgccaccaaagcaaaggtccctgcatgagaagatcctggaggagatcaagcaggagcggaggctgcgcccggtgcggggcgagggctgggctgcccgcgggtttggctctctgccctgcatcctcaacgcctgctccggagatgccaagtccacctcctgcatcaacctgtcagtcacagatgctgggggcagcgcccagcgcccgcggccccgcgtgctgctcaaggcgcctaccttggctgaaatggaagagatgaatacatctgaggaagaagagtctccgtgtggggaggtgacgctgaaacgggaccgctccttctcagagcatgacctggcccagctccgaagtgaggtggcctctggcctgcagtcggccacccaccccccaggagggacggagccaccacggccccgagctggcagtgcgcatgtgtggaggcccggctcccgagaccagggtacctgtcccgcgagtgtctctgaccccagccaccccctactcagcaaccggggctcctcgggggacagacccgaggcctccatgacccccgatgccaaacacctgtggctggagttcagccaccccgtggagagcctggcgctgactgtggaagaggtgatggacgtgcgccgtgtgctggtgaaggccgagatggaaaagtttttgcagaacaaggagctcttcagcagtctgaagaaggggaagatttgctgctgctgccgggccaagttcccgctgttctcgtggccgcccagctgtctcttctgcaagagagccgtctgcacttcctgtagcataaagatgaagatgccttctaagaaatttggacacatccctgtctacacactgggctttgagagtcctcagagggtatcagctgccaaaaccgcgccaatccagagaagagacatctttcagtctctgcaagggccacagtggcagagcgtggaggaggcgttcccccacatctactcccacggctgtgtcctgaaggatgtctgcagtgagtgcaccagctttgtggcagacgtggtgcgttccagccgcaagagcgtggacgtcctcaacactacgccacgacgcagtcgccagacccaatccctctacatccctaacaccaggactcttgacttcaagtgacagccccaggtggccaggcctccaggaggcaccaggcaggccctgtatcaggctaggacgctctgagctgtgcatgtacatatatacatatatagatacatttataatatatacacacagtctatatatttatatacactgtttcctggccccagagctcatttgggttcaggcgcacttcaaaaccctccctgggggaggctgtttcttctcaggattccttgccagggaggaaggggagggaacagggtgggttttctcactgaagagagaaagcagaaggttctagatcctggcacagactgcatcccatgttcccatgctcttctccgtccccaggaatgcgaacggcagtttcccttccccagtggacgtctaggtggggacagggtatcttggctcccagctggaccagagtgccctgcttgcctctgctctccctttgtggggactcaggcagcagaggcatctgggaagtctctgagtaggcagggtcctcctgggaggcacccccacctgtttgaaaggtctggccaggcgtggtggttcaggcctgtaattccagcactttgggaggccgaggagggaggatcacctgaggtcaggagtttgagaccagcctggccaacatgatgaaatgttgtctctactgaaaatgcaaaaattagccaggtatagtggcaggaacctgtaatcccagctacaggggaggctgaggcaggagaatcgcttgaacccgggaggtgtaggttgcagtgagccgagattgcaccactgcactccagcctgggcgacagagcgagactctgtctcgaaaaaaaaaaaggtccgtgccaagctgctccctgcccttgccctttccctttccctggggtccaaaccacatgtgtcctgcctctcctggccctaccacattctggtgctgtcctcactcgcccctggcccagaggctcctgaagatgctgggcggtcctggcacagggaggagcagctctgtaaatctgtgcacatggccactcttggcctaataaaggaggtctcacagtc

SEQ ID NO: 186021 - DNA, 2172 bp, Homo sapiens
  Payload ID: 16629
  Gene Symbol: SPIRE2
  Gene Name: spire-type actin nucleation factor 2
  Uniprot ID: Q8WWL2
  ENST ID: ENST00000393062
  CDS Start-End: 53-2053
cgcggctgcatggacgcgggtccggcgcgcgggaggcgatgacggccccgccatggcccgggcgggcagctgcggcggcgccgcggcgggcgcagggcggccggagccctgggagctgtccctggaggaggtgctgaaggcctacgagcagccgctcaacgaggagcaggcgtgggccgtgtgcttccagggctgccgcgggctgcggggctcgccgggccggcgcctgcgggataccggggacctcctgctgcgcggggacggctcggtcggggcgcgggagcccgaggccgcggaacctgcaaccatggtcgtgccactagccagctcggaagcccagaccgtgcagtccctcggcttcgccatctaccgcgcgctggactgggggctggacgagagcgaggagcgcgaactcagccctcagctggagcggctcatcgacctcatggccaacaacgacagcgaggacagcggctgcggtgccgccgatgagggctacgggggtcccgaggaggaggaggaggccgagggcgtcccccgcagcgtgcgcacctttgcccaggccatgcggctgtgcgcggcgcggctgaccgacccccggggcgcacaggcgcattaccaggccgtgtgccgcgcgctcttcgtggagacgctggagctgcgggccttcctggccagggtccgggaggccaaggagatgctgcagaagcttcgggaggacgagccgcatctggagacgcctcgggcagagctggacagcctgggtcacacagactgggcccgactgtgggttcagctcatgcgggagctccgccgcggagtgaagctgaagaaggtgcaagagcaggagttcaaccccctccccaccgagttccagctcacgcccttcgagatgctgatgcaggacatccgggcccggaactacaagctgcgcaaggtcatggtggatggggacatcccgccccgggtgaagaaggacgctcacgagctcatcctggactttatccgctcacggcctccactgaagcaggtctctgagaggcggctgcgcccgttgccaccaaagcaaaggtccctgcatgagaagatcctggaggagatcaagcaggagcggaggctgcgcccggtgcggggcgagggctgggctgcccgcgggtttggctctctgccctgcatcctcaacgcctgctccggagatgccaagtccacctcctgcatcaacctgtcagtcacagatgctgggggcagcgcccagcgcccgcggccccgcgtgctgctcaaggcgcctaccttggctgaaatggaagagatgaatacatctgaggaagaagagtctccgtgtggggaggtgacgctgaaacgggaccgctccttctcagagcatgacctggcccagctccgaagtgaggtggcctctggcctgcagtcggccacccaccccccaggagggacggagccaccacggccccgagctggcagtgcgcatgtgtggaggcccggctcccgagaccagggtacctgtcccgcgagtgtctctgaccccagccaccccctactcagcaaccggggctcctcgggggacagacccgaggcctccatgacccccgatgccaaacacctgtggctggagttcagccaccccgtggagagcctggcgctgactgtggaagaggtgatggacgtgcgccgtgtgctggtgaaggccgagatggaaaagtttttgcagaacaaggagctcttcagcagtctgaagaaggggaagatttgctgctgctgccgggccaagttcccgctgttctcgtggccgcccagctgtctcttctgcaagaggtctctgcaagggccacagtggcagagcgtggaggaggcgttcccccacatctactcccacggctgtgtcctgaaggatgtctgcagtgagtgcaccagctttgtggcagacgtggtgcgttccagccgcaagagcgtggacgtcctcaacactacgccacgacgcagtcgccagacccaatccctctacatccctaacaccaggactcttgacttcaagtgacagccccaggtggccaggcctccaggaggcaccaggcaggccctgtatcaggctaggacgctctgagctgtgcatgtacatatatacatatatagatacatttataatatatacacaca

SEQ ID NO: 186022 - DNA, 1823 bp, Homo sapiens
  Payload ID: 16629
  Gene Symbol: SPIRE2
  Gene Name: spire-type actin nucleation factor 2
  ENST ID: ENST00000563972
  CDS Start-End: 5-304
cgccatggcccgggcgggcagctgcggcggcgccgcggcgggcgcagggcggccggagccctgggagctgtccctggaggaggtgctgaaggcctacgagcagccgctcaacgaggagcaggcgtgggccgtgtgcttccagggctgccgcgggctgcggggctcgccgggccggcgcctgcgggataccggggacctcctgctgcgcggggacggctcggtcggggcgcgggagcccgaggccgcggaacctgcaaccatggtcgtgccactagccagctcggaagcccagctgcacagatgaggggcacagctgacgtctgcagggccggcctcccagacacagagccggggtcagggagacgacttcaggtgcaaacaggaaaaatcagcctggtgaccagtgccccgaaaccccacccgaccaaaactggaacctcaccgcagggcagggccttcctctcccattcacctgccctgaagtcatgtctggaacgtcatgtttccactttctactgcctttttagttttctttctttgttttttttgcttttgttcattttattttattttattgttttgagatggagtcgcgctctgtcgcccaggctggagtgcagtggtgtgatctcggcttactgcaagctccgcctcccgggttcacacctttctcctgcctcagcctcccaagtagctgggactactggtgcccgccaccacgcccggctaatttttttctatttttagtagagacggggtttcaccgtgttagccaggatggtcttgatgtcctgaccttgtgattcacctgcctcggcctcccaaagtgctgggattacaggagtgagccaccgcgcccggccttattttattttttaatagagatgtctcactatgttgcccggactagtctcaaactcctgggctcaagccatcctcccacttggcctcccaaagtgctgggattacagttctgagccactgtgcctggcctctttttttttttgagatagaatctccctctgtcacccaggttggactgcagtggtgcgatctcagctcactgcaacctcggctagttgcagcgcaacctccgtctcctgggttcaagcaattctcctgcctcagcctcccgagtagctgagattacaggcgcatgccaccacgcctggctaatttttgtgtttttttttgtttttgagacagagtctctctctgtcaccaggctggagtgcagtggcgtgatcttggctcactgcaacctccgcctcccgggttcacgccattctcctggccagcctctcaagtagctgggactacaggcgcccgccaccatgcccggctaatttttgtatttttagtagaagtggggtttcaccatgttggccaggatggtctcaaactcctgacctcatgattcacccacctcagcctcccaaactgctgggattacaggtgtgagccatcacgcccagcctttttttttttttttttagatctaccctcttgttgcccagggggagtccagtggcgtgatcttggctcactgcaaccgccgcctcccgggttcaagcaattctcctgcctcagtctcccgagtgtcttctgtcttttgtaaaagtttttcatgcccaagtgagattaattgtttaaaaaaaaaaaaacaagaagaaaacaacatagatttaccgcaagacctattgatatattattaaacatggtggtatacccagggtgggtgtgacacagaccaaaagaggctgtgtgttctgttgttgataatttaaaaacaataataaaaccgaagtctatgtcaccacaaa

SEQ ID NO: 186023 - DNA, 1369 bp, Homo sapiens
  Payload ID: 16629
  Gene Symbol: SPIRE2
  Gene Name: spire-type actin nucleation factor 2
  ENST ID: ENST00000566337
  CDS Start-End: 1-123
gggctgcggggctcgccgggccggcgcctgcgggataccggggacctcctgctgcgcggggacggctcggtcggggcgcgggagcccgaggccgcggttgaagaggtcagaaacccaggatgatccacctgtcaggggtcagcacctggaccctcaactgccactgtaagctcctctcggtacatgctcacaggttctggggttagaacacagacagctttaggggccgtgattctgccgactgcagcggaccgggggccgagaatctgagggagtgcccacaacccacctccagatcctcctccactgtctccagaacctgcaaccatggtcgtgccactagccagctcggaagcccagaccgtgcagtccctcggcttcgccatctaccgcgcgctggactgggggctggacgagagcgaggagcgcgaactcagccctcagctggagcggctcatcgacctcatggccaacaacgacagcgaggacagcggctgcggtgccgccgatgagggctacgggggtcccgaggaggaggaggaggccgagggcgtcccccgcagcgtgcgcacctttgcccaggccatgcggctgtgcgcggcgcggctgaccgacccccggggcgcacaggcgcattaccaggccgtgtgccgcgcgctcttcgtggagacgctggagctgcgggccttcctggccagggtccgggaggccaaggagatgctgcagaagcttcgggaggacgagccgcatctggagacgcctcgggcagagctggacagcctgggtcacacagactgggcccgactgtgggttcagctcatgcgggagctccgccgcggagtgaagctgaagaaggtgcaagagcaggagttcaaccccctccccaccgagttccagctcacgcccttcgagatgctgatgcaggacatccgggcccggaactacaagctgcgcaaggtcatggtggatggggacatcccgccccgggtgaagaaggacgctcacgagctcatcctggactttatccgctcacggcctccactgaagcaggtctctgagaggcggctgcgcccgttgccaccaaagcaaaggtccctgcatgagaagatcctggaggagatcaagcaggagcggaggctgcgcccggtgcggggcgagggctgggctgcccgcgggtttggctctctgccctgcatcctcaacgcctgctccggagatgccaagtccacctcctgcatcaacctgtcagtcacagatgctgggggcagcgcccagcgcccgcggccccgcgtgctgctcaaggcgcctaccttggctgaaatggaagagatgaatacatctgaggaagaagagtctccgtgtggggagg

SEQ ID NO: 186024 - DNA, 3120 bp, Homo sapiens
  Payload ID: 16630
  Gene Symbol: SPSB1
  Gene Name: splA/ryanodine receptor domain and SOCS box containing 1
  Uniprot ID: Q96BD6
  ENST ID: ENST00000328089
  CDS Start-End: 342-1163
gctttttctcctccgcacagaagtcgcgctcgggcagcctgcgcgctcgcagcaggaaccaggctccaggcgccggcgccggggccggggccgcggggaggaggcgacttcgctccctgcggcgggcgcggcccgggcgcccgagcctcctcggccttggagagcagcggcggcggcggcaccccgggcgcggcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaacatgggtcagaaggtcactggagggatcaagactgtggacatgagggaccccacgtacaggcccctgaagcaggagctccagggtctggattactgcaagcccacccggctggatctgctactggacatgccccctgtgtcctatgatgtccagctgctgcattcatggaacaacaacgaccgatcgctcaatgtctttgtgaaggaggacgacaagctcatctttcaccggcatccggtggcccagagcacggacgctatcaggggcaaagtcgggtatacccgtgggctgcacgtgtggcagatcacgtgggccatgagacagcggggcacacacgccgtggtgggggtggcgacggcagacgcccccctgcactctgtcgggtacacaaccctcgtggggaataaccacgagtcctggggctgggacttggggcgcaaccggctctaccacgatggcaagaaccagccaagcaaaacatacccagcctttctggaaccagatgagacattcattgtccctgactccttcctggtagccctggacatggacgacgggactctgagcttcattgtggatggacagtacatgggagtggcttttcggggactcaagggcaaaaaactgtatcctgtagtgagtgccgtctggggccactgtgagatccgaatgcgctacttgaacggactcgatcccgagccgctgccgctcatggatttgtgccgtcgctcggtgcgcctggccctggggagggagcgcctgggggagatccacacgctgccgctgccggcttccctcaaggcctacctcctctaccagtgacgttcgccatcataccgccagcgcgacagccacctggtgccaactcactgagccgcctgccgctggggccgccgcaccctgcaccttggaccggcatccgtagccatggacagaggtccctggtcttccctcatcctccgtggctgcctccatgggacaaggaccgattccaacacaggctcctctttcccccttcccgacatcagcagaaggcagcatccctgcatgccgtccgtatacaacccctctttgaaaaaagacacagagaataaactcctacgaaagccctacattgagctccaatctgctcggggtgggacgggtgcttcccacacctctgggagaaggctgcagccacctgggggtcccagggtggtgggggtggcaggtggtaccacagctctgagagcagataccaggggtactaagaggtgcttagacaagggctggtgcccggcccagggtgcccagcggggccatgccatggcagataaagctcaggacgtcaaaaactcaccatggaccccaaggcagaaaccaagaactgtctgcaggcaaataagcacccagcacccatcctggctgccggtgccccgtaccctgtatttattcttttaacaataacaaaagccatttatttattccatctagaaaggaaaccctgtttcagtcccctctctctggctgttctgttactttccttccacctgtgccctccctgggatatgtatgcctcgcccgccctccctgggcacatgtgcacacgtgcccaggcacaagtatgtctctgggtcccttgccctgcagtttccagggggctctgctccaagttccctagcgggcccctcagggagaaatagcctcacgtgcaatctgggtgtcttcgggggcccgtctggaagggctgcagcaattcccctgtgtctccaggtaaccagctaactcttgggctcaggcacccttgcacagggttgcatttctttagtcttctgtgggtcttttgatgtgggtttgattttgcttttgcttttctagctgagatttcccaagtgcatcctcagaagctctgggtgtgccagaggacccccagaactaagaagggagggcgagtgggtctccattccccgagaagccgggggcagggtgggatggggaagaccaggagcagagtcgagcctcacagaagccagcgcgggtctctgctcagcaccccagccggggctctggacccagggtaacagccccagttcatcccaacccctctcagagcctcaagaggggtagctcggctgccggaagagaggggtgccctatccctggcaacccctccacgtagcgtaccccagcacctgccaccgcctttgccatttctttgagcttgaagttaactctcttagagtctaactttggttcatttctgcacaggtacaatagatgactttatttgtttaaaatgtttaatatatatacatacatatatatatatttgtctgtaagaattatgttttaaacagctgctgtagagtacctttttttaagtaaatcttacagtggagtatattttttaaagcacaaaattggtgccaagactgggtgagaaatgtacattacccccttattattttgacggttttttttttcggggcaggggaccttacctgtaagacttttaaagattttcctccctcctgtttcaggtgggtcacattctgatgaatgtttcccttgtacagatcccagcttatggccttgacccagccgtcctcacagatgccgggtgaccctctagctctctctgcatctcccaccccccgacaccctgggaccctcgaccccacccttctttcctaccagcccagagccttgtggcttgtacagttttgaaactcccgttctattttatgatggttgataatagtcagtaacctaataaaggaacgtttgttaaaatatcaaa

SEQ ID NO: 186025 - DNA, 1439 bp, Homo sapiens
  Payload ID: 16630
  Gene Symbol: SPSB1
  Gene Name: splA/ryanodine receptor domain and SOCS box containing 1
  Uniprot ID: Q96BD6
  ENST ID: ENST00000357898
  CDS Start-End: 330-1151
ccctctctggaacactgtctccactgagttttaggtaagtgtgtgacagacaaacgagcagaagcttggagaagctcagggtggatcttggtggccggagctactgtctcggcgcatgagcttggaagcttcaggaagcagggctggggaagcaccctccaggctgcagttccagggaaggcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaacatgggtcagaaggtcactggagggatcaagactgtggacatgagggaccccacgtacaggcccctgaagcaggagctccagggtctggattactgcaagcccacccggctggatctgctactggacatgccccctgtgtcctatgatgtccagctgctgcattcatggaacaacaacgaccgatcgctcaatgtctttgtgaaggaggacgacaagctcatctttcaccggcatccggtggcccagagcacggacgctatcaggggcaaagtcgggtatacccgtgggctgcacgtgtggcagatcacgtgggccatgagacagcggggcacacacgccgtggtgggggtggcgacggcagacgcccccctgcactctgtcgggtacacaaccctcgtggggaataaccacgagtcctggggctgggacttggggcgcaaccggctctaccacgatggcaagaaccagccaagcaaaacatacccagcctttctggaaccagatgagacattcattgtccctgactccttcctggtagccctggacatggacgacgggactctgagcttcattgtggatggacagtacatgggagtggcttttcggggactcaagggcaaaaaactgtatcctgtagtgagtgccgtctggggccactgtgagatccgaatgcgctacttgaacggactcgatcccgagccgctgccgctcatggatttgtgccgtcgctcggtgcgcctggccctggggagggagcgcctgggggagatccacacgctgccgctgccggcttccctcaaggcctacctcctctaccagtgacgttcgccatcataccgccagcgcgacagccacctggtgccaactcactgagccgcctgccgctggggccgccgcaccctgcaccttggaccggcatccgtagccatggacagaggtccctggtcttccctcatcctccgtggctgcctccatgggacaaggaccgattccaacacaggctcctctttcccccttcccgacatcagcagaaggcagcatccctgcatgccgtccgtatacaacccctctttgaaaaaagacacagagaataaactcctacgaaagccc

SEQ ID NO: 186026 - DNA, 1007 bp, Homo sapiens
  Payload ID: 16630
  Gene Symbol: SPSB1
  Gene Name: splA/ryanodine receptor domain and SOCS box containing 1
  Uniprot ID: Q96BD6
  ENST ID: ENST00000377399
  CDS Start-End: 186-1007
tcctgctcaccggttgtttgtctttccgtccattaggcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaacatgggtcagaaggtcactggagggatcaagactgtggacatgagggaccccacgtacaggcccctgaagcaggagctccagggtctggattactgcaagcccacccggctggatctgctactggacatgccccctgtgtcctatgatgtccagctgctgcattcatggaacaacaacgaccgatcgctcaatgtctttgtgaaggaggacgacaagctcatctttcaccggcatccggtggcccagagcacggacgctatcaggggcaaagtcgggtatacccgtgggctgcacgtgtggcagatcacgtgggccatgagacagcggggcacacacgccgtggtgggggtggcgacggcagacgcccccctgcactctgtcgggtacacaaccctcgtggggaataaccacgagtcctggggctgggacttggggcgcaaccggctctaccacgatggcaagaaccagccaagcaaaacatacccagcctttctggaaccagatgagacattcattgtccctgactccttcctggtagccctggacatggacgacgggactctgagcttcattgtggatggacagtacatgggagtggcttttcggggactcaagggcaaaaaactgtatcctgtagtgagtgccgtctggggccactgtgagatccgaatgcgctacttgaacggactcgatcccgagccgctgccgctcatggatttgtgccgtcgctcggtgcgcctggccctggggagggagcgcctgggggagatccacacgctgccgctgccggcttccctcaaggcctacctcctctaccagtga

SEQ ID NO: 186027 - DNA, 822 bp, Homo sapiens
  Payload ID: 16630
  Gene Symbol: SPSB1
  Gene Name: splA/ryanodine receptor domain and SOCS box containing 1
  ENST ID: ENST00000450402
  CDS Start-End: 217-822
cctctctccatttctctgaaaatgaactacacagtttgggggtgagttggcaggggctgcttcctgagcaatactgaacactgcgcagcttgcagaggtctcctggcagccctcattaggaattctgtctggccccgatcagaatactggagacgagaccacgagattgatgagtttgccttgggagtcggtaagaaggtgaagccaggggcgaacatgggtcagaaggtcactggagggatcaagactgtggacatgagggaccccacgtacaggcccctgaagcaggagctccagggtctggattactgcaagcccacccggctggatctgctactggacatgccccctgtgtcctatgatgtccagctgctgcattcatggaacaacaacgaccgatcgctcaatgtctttgtgaaggaggacgacaagctcatctttcaccggcatccggtggcccagagcacggacgctatcaggggcaaagtcgggtatacccgtgggctgcacgtgtggcagatcacgtgggccatgagacagcggggcacacacgccgtggtgggggtggcgacggcagacgcccccctgcactctgtcgggtacacaaccctcgtggggaataaccacgagtcctggggctgggacttggggcgcaaccggctctaccacgatggcaagaaccagccaagcaaaacatacccagcctttctggaaccagatgagacattcattgtccctgactccttcctggtagccctggacatggacgacgggactctgagcttcattgtggatggacagtacatgggagtggcttttcgg

SEQ ID NO: 186028 - DNA, 1236 bp, Homo sapiens
  Payload ID: 16631
  Gene Symbol: SPSB2
  Gene Name: splA/ryanodine receptor domain and SOCS box containing 2
  Uniprot ID: Q99619
  ENST ID: ENST00000524270
  CDS Start-End: 188-979
ggccggcggtctgcgccctgcgcgcctcggcttctttccgcccggctccttcagaggcccggcgacctccagggctgggaagtcaaccgagctcccttccaggtcaatccaaactggagctcaactttcagaagagaaagacgccccagcaagcctctttcggggagtcctctagctcctcacctccatgggccagacagctctggcagggggcagcagcagcacccccacgccacaggccctgtaccctgacctctcctgtcccgagggcttggaagagctgctgtctgcaccccctcctgacctgggggcccagcggcgccacggttggaaccccaaagactgttcagagaacatcgaggtcaaggaaggagggttgtactttgagcggcggcccgtggcccagagcactgatggggcccggggtaagaggggctattcaaggggcctgcacgcctgggagatcagctggcccctagagcagaggggcacgcatgccgtggtgggcgtggccacggccctcgccccgctgcagactgaccactacgcggcgctgctgggcagcaacagcgagtcgtggggctgggacatcgggcgggggaagctgtaccatcagagcaaggggcccggagccccccagtatccagcgggaactcagggtgagcagctggaggtgccagagagactgctggtggttctggacatggaggagggaactctgggctacgctattgggggcacctacctggggccagcattccgcggactgaagggcaggaccctctatccggcagtaagcgctgtctggggccagtgccaggtccgcatccgctacctgggcgaaaggagagcggagccacactcccttctgcacctgagccgcctgtgtgtgcgccacaacctgggggatacccggctcggccaggtgtctgccctgcccttgccccctgccatgaagcgctacctgctctaccagtgagccctgtgataccacagactgtgctgaggtcttgccaccacccctccccttggggaggtggggaggcactgctggcctagaccagctgctgaaagctggtgaggctgagcccctaccccaacccaagctctgcggaaatcaacagccccagagccacttggagggaggaagaaagggagccggcgttcaaggctatgacagtctgctacgcaaaacattttttcaagtaaaaatagtaagagatgttgttatagaaa

SEQ ID NO: 186029 - DNA, 679 bp, Homo sapiens
  Payload ID: 16631
  Gene Symbol: SPSB2
  Gene Name: splA/ryanodine receptor domain and SOCS box containing 2
  ENST ID: ENST00000432205
  CDS Start-End: 433-679
agacaaggtttccctctgtaacccaggctggagtgcagtggaacttctgagctcaagtagtcttcacatctcagccttccaagtagctgtgactagagcttgtgacagtccagccccttcagcctggagttccacctaccagtccccacatgtgctgtctctcaccaaggttgccagtgacctctgaccaaaacaatcttgggcgcaggagttagtcgctcaggcggctcaaaggtcttgacggtggagaacaccatccccagggattcccgacgcggtgatgccatcaaagcgttaattctgagatgggcctgcccgggtgcggactctgccgcactcccttccaggtcaatccaaactggagctcaactttcagaagagaaagacgccccagcaagcctctttcggggagtcctctagctcctcacctccatgggccagacagctctggcagggggcagcagcagcacccccacgccacaggccctgtaccctgacctctcctgtcccgagggcttggaagagctgctgtctgcaccccctcctgacctgggggcccagcggcgccacggttggaaccccaaagactgttcagagaacatcgaggtcaaggaaggagggttgtactttgagcggcggcccgtggcccagagcactgatggggcccggggtaagaggg

SEQ ID NO: 186030 - DNA, 1205 bp, Homo sapiens
  Payload ID: 16631
  Gene Symbol: SPSB2
  Gene Name: splA/ryanodine receptor domain and SOCS box containing 2
  Uniprot ID: Q99619
  ENST ID: ENST00000523102
  CDS Start-End: 157-948
cagaggcccggcgacctccagggctgggaagtcaaccgaggttcgggggcagcggcgagggctccgggcgagtcaatccaaactggagctcaactttcagaagagaaagacgccccagcaagcctctttcggggagtcctctagctcctcacctccatgggccagacagctctggcagggggcagcagcagcacccccacgccacaggccctgtaccctgacctctcctgtcccgagggcttggaagagctgctgtctgcaccccctcctgacctgggggcccagcggcgccacggttggaaccccaaagactgttcagagaacatcgaggtcaaggaaggagggttgtactttgagcggcggcccgtggcccagagcactgatggggcccggggtaagaggggctattcaaggggcctgcacgcctgggagatcagctggcccctagagcagaggggcacgcatgccgtggtgggcgtggccacggccctcgccccgctgcagactgaccactacgcggcgctgctgggcagcaacagcgagtcgtggggctgggacatcgggcgggggaagctgtaccatcagagcaaggggcccggagccccccagtatccagcgggaactcagggtgagcagctggaggtgccagagagactgctggtggttctggacatggaggagggaactctgggctacgctattgggggcacctacctggggccagcattccgcggactgaagggcaggaccctctatccggcagtaagcgctgtctggggccagtgccaggtccgcatccgctacctgggcgaaaggagagcggagccacactcccttctgcacctgagccgcctgtgtgtgcgccacaacctgggggatacccggctcggccaggtgtctgccctgcccttgccccctgccatgaagcgctacctgctctaccagtgagccctgtgataccacagactgtgctgaggtcttgccaccacccctccccttggggaggtggggaggcactgctggcctagaccagctgctgaaagctggtgaggctgagcccctaccccaacccaagctctgcggaaatcaacagccccagagccacttggagggaggaagaaagggagccggcgttcaaggctatgacagtctgctacgcaaaacattttttcaagtaaaaatagtaagagatgttgttatagaaa

SEQ ID NO: 186031 - DNA, 1496 bp, Homo sapiens
  Payload ID: 16631
  Gene Symbol: SPSB2
  Gene Name: splA/ryanodine receptor domain and SOCS box containing 2
  Uniprot ID: Q99619
  ENST ID: ENST00000519357
  CDS Start-End: 188-991
ggccggcggtctgcgccctgcgcgcctcggcttctttccgcccggctccttcagaggcccggcgacctccagggctgggaagtcaaccgagctcccttccaggtcaatccaaactggagctcaactttcagaagagaaagacgccccagcaagcctctttcggggagtcctctagctcctcacctccatgggccagacagctctggcagggggcagcagcagcacccccacgccacaggccctgtaccctgacctctcctgtcccgagggcttggaagagctgctgtctgcaccccctcctgacctgggggcccagcggcgccacggttggaaccccaaagactgttcagagaacatcgaggtcaaggaaggagggttgtactttgagcggcggcccgtggcccagagcactgatggggcccggggtaagaggggctattcaaggggcctgcacgcctgggagatcagctggcccctagagcagaggggcacgcatgccgtggtgggcgtggccacggccctcgccccgctgcagactgaccactacgcggcgctgctgggcagcaacagcgagtcgtggggctgggacatcgggcgggggaagctgtaccatcagagcaaggggcccggagccccccagtatccagcgggaactcagggtgagcagctggaggtgccagagagactgctggtggttctggacatggaggagggaactctgggctacgctattgggggcacctacctggggccagcattccgcggactgaagggcaggaccctctatccggcagtaagcgctgtctggggccagtgccaggtccgcatccgctacctgggcgaaaggagaggtgaggcctggggcagacgtggggagaactttctgtccctggtggcagtggtttgggatggaaactcttctgacaagagcagaggggatggaccttcatccagcctgcctcaacctctgttcagtgctgggaaaggctaggggtcttcacagctgttatttaatttaacccaacagcaatagaggtgaaacaggcttgagaaagcaactttctcaagttctcttggccagtaaatggtgaaccttcagaatggagggaggaactgcagggatgagagaattcaggagatatcaacccctgagcaagaggtgcaaagcgttaggtactgggtttgatgtacaggtccaaaagaaggatgggcagagccaggtacccaggctgtataccggattccctgggctctaacctgtctctgtgccacatacctacttccttcctcagccacacctctggatggagacactggggccctgggcaccagggaggagagcagtggaggaggcagggccttagggtggggcagcaggggaggagcctccccaggaactgactgggtccagggcttggagctgctctctgcagttgtgtgggctgtagagtggagggccatccctcctcacctcagccccagctcccaagcctctg

SEQ ID NO: 186032 - DNA, 1449 bp, Homo sapiens
  Payload ID: 16632
  Gene Symbol: SPSB3
  Gene Name: splA/ryanodine receptor domain and SOCS box containing 3
  Uniprot ID: Q6PJ21
  ENST ID: ENST00000301717
  CDS Start-End: 34-1101
agagcctgtgttttcttctagattctttccaccatggccagacgcccccggaacagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatgatggtgggcatcgggacgtcggatgtggacctggacaaataccgccacacgttctgcagcctgctgggcagggatgaggacagctggggcctctcctacacgggcctcctccaccacaagggcgacaagaccagcttctcatcgcggttcggccagggctccatcattggcgtgcacctggacacctggcacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcagccgccgcaaggctccagtgtccgatccccaggcagcgacctccgcccaccccagcagtcgcgagcctcggccctgccagaggaagcgctgccgccggacctgactgacttcccagtggaactgccttcttgggctgggacagcccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctgtcagcggctgccccgccgtcatagacttaaa

SEQ ID NO: 186033 - DNA, 580 bp, Homo sapiens
  Payload ID: 16632
  Gene Symbol: SPSB3
  Gene Name: splA/ryanodine receptor domain and SOCS box containing 3
  ENST ID: ENST00000569769
  CDS Start-End: 77-580
agacgtaccctccctcgctgcctgcctgcagcctgccctgcatgcaggatggccctgaggaaagattctttccaccatggccagacgcccccggaacagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatgatggtgggcatc

SEQ ID NO: 186034 - DNA, 1784 bp, Homo sapiens
  Payload ID: 16632
  Gene Symbol: SPSB3
  Gene Name: splA/ryanodine receptor domain and SOCS box containing 3
  Uniprot ID: Q6PJ21
  ENST ID: ENST00000566339
  CDS Start-End: 332-1399
gatgacacggacctactttccggtcaacgcggcctgcggtaccacctcccacccgggtccaatgtgcgcgcgagctttgtctccaaccgcttgggaactgaccaataggaacgttggattaggactgacagttcctgaaacctctcggcaatagctttgtcacccgactcccgccccctctcccgaagctccgagacaggtgtgcccgcccctcgccgccggagccaatgggcgcagggggcggggattgtttacgtctcgctccggggcggaaagtgggtcagggccgggccggcggagcgcgcagcgggggctgcagattctttccaccatggccagacgcccccggaacagcagggcctggcacttcgtcctgagtgcagcccgccgagacgcagatgcccgggccgtggctctagcaggctccactaactggggctacgactctgatgggcagcacagcgactcggactccgaccccgagtactccacgctgccgccatccatccccagtgcggtgcccgtgaccggcgagtccttctgtgactgtgctgggcagagcgaggcctccttctgtagcagcctgcactcggcccaccggggcagggactgccgctgcggagaggaagacgagtatttcgactgggtctgggatgacttaaataagtcatcagccaccctgctgagctgtgacaaccgtaaggtcagcttccacatggagtacagctgcggcacagcggccatccggggcaccaaggagctgggggagggccagcacttctgggagatcaagatgacctctcccgtctacggcaccgacatgatggtgggcatcgggacgtcggatgtggacctggacaaataccgccacacgttctgcagcctgctgggcagggatgaggacagctggggcctctcctacacgggcctcctccaccacaagggcgacaagaccagcttctcatcgcggttcggccagggctccatcattggcgtgcacctggacacctggcacggcacactcacctttttcaagaacaggaagtgtataggtgtggcagccaccaagctgcagaacaagagattctacccgatggtgtgctccacggcggcccggagcagcatgaaggtcacccgctcctgtgccagcgccacttccctccagtacctgtgctgccaccgcctgcgccagctgcggccagactcgggagacacgctggagggtctgccgctgccgccgggcctcaagcaggtgctacacaacaagctgggctgggtcctgagcatgagttgcagccgccgcaaggctccagtgtccgatccccaggcagcgacctccgcccaccccagcagtcgcgagcctcggccctgccagaggaagcgctgccgccggacctgactgacttcccagtggaactgccttcttgggctgggacagcccctttcctctgtcccttctttctctgtcccttccttccagccacactccagggcggagttggatgaggcccgtccggagggagccatctcttgctcccgaggctgggacagtcctttctgtgggggctctagggcccctctgctgctgtgctgggtggggaagcggctgccctgagccccaggtcttgtgggaggctgcgaggacgagagcctggctggagcccgcgttgctgttcccacagggcctcggtttttcctaacttgctctgcatgctgtcagcggctgccccgccgtcatagacttaaaggactgcaataaatgtagagttgatgtctaacaccca

SEQ ID NO: 186035 - DNA, 2908 bp, Homo sapiens
  Payload ID: 16633
  Gene Symbol: SPSB4
  Gene Name: splA/ryanodine receptor domain and SOCS box containing 4
  Uniprot ID: Q96A44
  ENST ID: ENST00000310546
  CDS Start-End: 745-1566
cggcggcggaggagggggaggcggcggcggctgcagcatccagagctggccgtggcggccggcgcgccccgcgcacaaaagcacccagccccaggggagggcgatgaacacaccacatcccgggcccgggccccagctgctgctaccgctgcgtgcgctcagggcgctggggaagacgcccggcgcgccgggggccagcggccgaggcgcggcccgtgcgccctgagcgcgggactcgtcgccctccgggtcaggcgccaagcttccaagcggctagagcgcgggccttggagcgcccccaggatcgcttcagtaaggcgcttccccactccaggcccgacccccggcgcctgagcgccaacttcgccaagaacgctcctaactccaggccatcctgcagcgcagagggggcgctgctgccgggcatcagccgtgaggacgcgcccctggccgtgcggagagagccggcatttgcgggtcactcgggcgcccctgagtgggcggcggcggcagcagacccctctccagggagtccaggacctgccagcgctggggattcttcccgaacaggcgcttgccctctcttttatggagcttgggcccctgccgcagcccggtagaggctgtggaggtctaccgtccggaagcctggttcccagccccgtggcccattcctggctacggggagtggaggctcccacgaggtagcggtggcctgcagcggcctcctccccgcagtgaagcatgggccagaagctctcggggagcctcaagtcagtggaggtgcgagagccggcgctgcggccggccaagcgggagctgcggggtgcagagcccgggcggccggcgcggctggaccagctgttggacatgccagcggcggggctggctgtgcagctgcggcacgcgtggaaccccgaggaccgctcgctcaacgtcttcgtcaaggacgacgaccggctcaccttccaccggcaccccgtggcccagagcaccgacggcatccgcggcaaggtgggccacgcccgcggcctgcacgcctggcagatcaactggccggctcggcagcgcggcacccacgctgtagttggtgtggccacggcccgtgctcccctgcactccgtgggctacacggcgctggtaggcagtgacgccgagtcgtggggctgggacctgggccgcagccgcctctaccacgacggcaagaaccagcccggcgtggcctacccggcctttctggggcccgacgaggcctttgcgctgcccgactcgctgctcgtggtgctggacatggatgagggcacactcagcttcatcgtggatggccagtacctgggcgtggccttccgaggtctcaagggcaagaagctgtacccggtggtgagtgccgtgtggggccactgtgaagtcaccatgcgctacatcaacggccttgaccccgagcccctgccactgatggacctgtgccggagatccatccgctcggccctgggccgccagcgcctgcaggacatcagctccctgcccctgcctcagtctctcaaaaactatctgcagtaccagtgagccaagcctgatgggcagcacagacacagacacacaccgcagggcccgaccctcctgtcattcacagtcccatggcacataggggaaaggatctacccttctcctggctccccaggacactcagttctttcaaagaccaggatgtggtaccaactttggaaacgaaaggtctcttgccaacagtatctactgccctcgaggcagccctcccaagtcagacacctccttcggagccacagagagcctggagtctgcacctcctggaaatcctgccaccaaccaggacacagcagccaccgtattgatcagagagcctgtttccttattcaagagaatgaataaaacatttaggcaggagactttctattgtgtgccccgttgcagacagggccagggagaaattagccagtgcagggggaaaattgcctctgaataatgaatgatgaaagcctgacgccgtgcccctcctggcccatacgccttgccagggcggcaggattgtcacaccgttttaggactctgtgccactttgagagactgttcccaggaggcccaaccgcagacctggcaagtggacagtgcagtgtggagacaccttccggcttacctctttgaacgttgtttacctacccctttccacgtgctccccttcccagccactgactcacagttctctggatgcccagacacctctcttcagggaagatgagtctgactggtttgccccagggaagagcatatccttaccattattttaagtagcatttgcattttaaaagaggaatgcggagaggacagtacttagtccaaaggtgctaacgggggaactgggggcattgtgacacccaagtctgatgtgtcctgggttggggggccttcctggagtgtcagggtctctgggcaacgtccattcagggtgcggcatggctgtcacaaagctttatttgagcaaattattttttcactttaggagacttctacaagtttgtttcctgtttcaaatgtgtgtgtgatgtgctgtttatttatcagcttgaggtccatgggggcagccttgtgactggaagggtggatatgggagacacattctctacctgctccgagcctggtcctctcgcaggaatgctgctgctgcctccgccgccactgctgctgccacctcttatatgtttcagacactctctgcccagactcatttttaactggaaatcatcacagcagtgggatatcagagccccagacagcactgcctcttcctccccaccccactgcccccaccttaatgtgaatttgactgatgaatgaagagcgtttctaataaagtttgtcattcagtccttca

SEQ ID NO: 186036 - DNA, 1752 bp, Homo sapiens
  Payload ID: 16633
  Gene Symbol: SPSB4
  Gene Name: splA/ryanodine receptor domain and SOCS box containing 4
  ENST ID: ENST00000508126
  CDS Start-End: 1-271
cgtggtgctggacatggatgagggcacactcagcttcatcgtggatggccagtacctgggcgtggccttccgaggtctcaagggcaagaagctgtacccggtggtgagtgccgtgtggggccactgtgaagtcaccatgcgctacatcaacggccttgaccatggagtctcactcggttgccctggccaaagtgcagtggcacgatctcggctcactgcaacctccgcctcccgggttcaagctattcttctgcctcagcttcccgagtagctgggactacagccgagcccctgccactgatggacctgtgccggagatccatccgctcggccctgggccgccagcgcctgcaggacatcagctccctgcccctgcctcagtctctcaaaaactatctgcagtaccagtgagccaagcctgatgggcagcacagacacagacacacaccgcagggcccgaccctcctgtcattcacagtcccatggcacataggggaaaggatctacccttctcctggctccccaggacactcagttctttcaaagaccaggatgtggtaccaactttggaaacgaaaggtctcttgccaacagtatctactgccctcgaggcagccctcccaagtcagacacctccttcggagccacagagagcctggagtctgcacctcctggaaatcctgccaccaaccaggacacagcagccaccgtattgatcagagagcctgtttccttattcaagagaatgaataaaacatttaggcaggagactttctattgtgtgccccgttgcagacagggccagggagaaattagccagtgcagggggaaaattgcctctgaataatgaatgatgaaagcctgacgccgtgcccctcctggcccatacgccttgccagggcggcaggattgtcacaccgttttaggactctgtgccactttgagagactgttcccaggaggcccaaccgcagacctggcaagtggacagtgcagtgtggagacaccttccggcttacctctttgaacgttgtttacctacccctttccacgtgctccccttcccagccactgactcacagttctctggatgcccagacacctctcttcagggaagatgagtctgactggtttgccccagggaagagcatatccttaccattattttaagtagcatttgcattttaaaagaggaatgcggagaggacagtacttagtccaaaggtgctaacgggggaactgggggcattgtgacacccaagtctgatgtgtcctgggttggggggccttcctggagtgtcagggtctctgggcaacgtccattcagggtgcggcatggctgtcacaaagctttatttgagcaaattattttttcactttaggagacttctacaagtttgtttcctgtttcaaatgtgtgtgtgatgtgctgtttatttatcagcttgaggtccatgggggcagccttgtgactggaagggtggatatgggagacacattctctacctgctccgagcctggtcctctcgcaggaatgctgctgctgcctccgccgccactgctgctgccacctcttatatgtttcagacactctctgcccagactcatttttaactggaaatcatcacagcagtgggatatcagagccccagacagcactgcctcttcctccccaccccactgcccccaccttaatgtgaatttgactgatgaatgaagagcgtttctaataaagtttgtcattcagtccttc

SEQ ID NO: 186037 - DNA, 4990 bp, Homo sapiens
  Payload ID: 16634
  Gene Symbol: SYK
  Gene Name: spleen tyrosine kinase
  Uniprot ID: P43405
  ENST ID: ENST00000375746
  CDS Start-End: 134-2041
tcctctcagatttgtgtgcttcttcccttcccacattctatactgcccagcgcctgggattccagatctgcgtttgaatccaggaaagggaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgacttggtcagcgggtggaataatctcaagaatcaaatcatactccttcccaaagcctggccacagaaagtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttg

SEQ ID NO: 186038 - DNA, 4908 bp, Homo sapiens
  Payload ID: 16634
  Gene Symbol: SYK
  Gene Name: spleen tyrosine kinase
  Uniprot ID: P43405
  ENST ID: ENST00000375747
  CDS Start-End: 121-1959
ctttctggtaaggagaggaggttacggggaacgacgcgctgctttcatgccctttcttgttctaccttcatcggccgaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttg

SEQ ID NO: 186039 - DNA, 4936 bp, Homo sapiens
  Payload ID: 16634
  Gene Symbol: SYK
  Gene Name: spleen tyrosine kinase
  Uniprot ID: P43405
  ENST ID: ENST00000375751
  CDS Start-End: 149-1987
gaggaagagccgcgggcccggcggctgaggccaccccggcggcggctggagagcgaggaggagcgggtggccccgcgctgcgcccgccctcgcctcacctggcgcaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttg

SEQ ID NO: 186040 - DNA, 5005 bp, Homo sapiens
  Payload ID: 16634
  Gene Symbol: SYK
  Gene Name: spleen tyrosine kinase
  Uniprot ID: P43405
  ENST ID: ENST00000375754
  CDS Start-End: 149-2056
gaggaagagccgcgggcccggcggctgaggccaccccggcggcggctggagagcgaggaggagcgggtggccccgcgctgcgcccgccctcgcctcacctggcgcaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgacttggtcagcgggtggaataatctcaagaatcaaatcatactccttcccaaagcctggccacagaaagtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttg

SEQ ID NO: 186041 - DNA, 2850 bp, Homo sapiens
  Payload ID: 16635
  Gene Symbol: SF1
  Gene Name: splicing factor 1
  Uniprot ID: Q15637
  ENST ID: ENST00000227503
  CDS Start-End: 356-2002
gcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaagatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 186042 - DNA, 3094 bp, Homo sapiens
  Payload ID: 16635
  Gene Symbol: SF1
  Gene Name: splicing factor 1
  Uniprot ID: Q15637
  ENST ID: ENST00000334944
  CDS Start-End: 395-2311
cggagctcagttcacgcagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 186043 - DNA, 2947 bp, Homo sapiens
  Payload ID: 16635
  Gene Symbol: SF1
  Gene Name: splicing factor 1
  Uniprot ID: Q15637
  ENST ID: ENST00000377387
  CDS Start-End: 78-2099
cctccccccgggaggcttgcgaaggagaagccgccgcagaggaaaagcaggtgccggtgcctgtccccgggggcgccatggcgaccggagcgaacgccacgccgttgggtaagctgggcccccccgggctgcccccgctccccgggcccaaaggaggcttcgagccgggccctccgcctgcacccgggcctggggcggggctgctggctcccgggccgccgccgcccccgcccgtgggctcgatgggggccctgaccgcggccttccccttcgcggcgctgcctccgccgcctccgccgccgccccctccgcctccccagcagccgccgccgcctccaccgccaccgtcccccggcgcctcgtacccgccgccgcagccgccccctccgccgccgctctaccagcgcgtgtcgccgccgcagccgccgccaccccagccgccgcgtaaggaccagcagccgggcccggccggcggcggaggagacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaagatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 186044 - DNA, 3470 bp, Homo sapiens
  Payload ID: 16635
  Gene Symbol: SF1
  Gene Name: splicing factor 1
  Uniprot ID: Q15637
  ENST ID: ENST00000377390
  CDS Start-End: 339-2258
accgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 186045 - DNA, 2854 bp, Homo sapiens
  Payload ID: 16635
  Gene Symbol: SF1
  Gene Name: splicing factor 1
  Uniprot ID: Q15637
  ENST ID: ENST00000377394
  CDS Start-End: 356-2071
gcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatgggtaaatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaagatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 186046 - DNA, 623 bp, Homo sapiens
  Payload ID: 16635
  Gene Symbol: SF1
  Gene Name: splicing factor 1
  ENST ID: ENST00000413951
  CDS Start-End: 116-271
ggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggccgccgccgcctccaccgccaccgtcccccggcgcctcgtacccgccgccgcagccgccccctccgccgccgctctaccagcgcgtgtcgccgccgcagccgccgccaccccagccgccgcgtaaggaccagcagccgggcccggccggcggcggaggagacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatg

SEQ ID NO: 186047 - DNA, 767 bp, Homo sapiens
  Payload ID: 16635
  Gene Symbol: SF1
  Gene Name: splicing factor 1
  ENST ID: ENST00000443908
  CDS Start-End: 1-603
tctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggtccctgctctttccttccatcaagatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaagatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttccttt

SEQ ID NO: 186048 - DNA, 843 bp, Homo sapiens
  Payload ID: 16635
  Gene Symbol: SF1
  Gene Name: splicing factor 1
  ENST ID: ENST00000413725
  CDS Start-End: 1-541
gaaccagggcccccaccctcctgggcaccatggccctcctccaatgggtaaatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcct

SEQ ID NO: 186049 - DNA, 2317 bp, Homo sapiens
  Payload ID: 16635
  Gene Symbol: SF1
  Gene Name: splicing factor 1
  Uniprot ID: Q15637
  ENST ID: ENST00000433274
  CDS Start-End: 310-2151
gacgcagtgaggtggccgggctgtgcggcgcaactgtatagactgggggcccactattgctgtccagtccgctggtgtcgggaacaggggtggcgggtgttcagcgctggacggggtgctagctgtgaatgccagcagggcgtgaaagcctcacctgatgacgtgcagcgactcccttctggtcttgaggaaccagaatgggaaccgtaccaaggatagctcctctgcttctacagcaaggcagggttttcatccgggagagacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattc

SEQ ID NO: 186050 - DNA, 475 bp, Homo sapiens
  Payload ID: 16635
  Gene Symbol: SF1
  Gene Name: splicing factor 1
  ENST ID: ENST00000432725
  CDS Start-End: 289-475
agacgcagtgaggtggccgggctgtgcggcgcaactgtatagactgggggcccactattgctgtccagtccgctggtgtcgggaacaggggtggcgggtgttcagcgctggacggggtgctagctgtgaatgccagcagggcgtgaaagcctcacctgatgacgtgcagcgactcccttctggtcttgaggaaccagaatgggaaccgtaccaaggatagctcctctgcttctacagcaagacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaata

SEQ ID NO: 186051 - DNA, 2778 bp, Homo sapiens
  Payload ID: 16635
  Gene Symbol: SF1
  Gene Name: splicing factor 1
  ENST ID: ENST00000448404
  CDS Start-End: 356-688
gcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatataggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatgggtaaatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaagatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 186052 - DNA, 875 bp, Homo sapiens
  Payload ID: 16635
  Gene Symbol: SF1
  Gene Name: splicing factor 1
  ENST ID: ENST00000486867
  CDS Start-End: 1-875
accaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccgggg

SEQ ID NO: 186053 - DNA, 704 bp, Homo sapiens
  Payload ID: 16635
  Gene Symbol: SF1
  Gene Name: splicing factor 1
  ENST ID: ENST00000626028
  CDS Start-End: 372-704
aaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatataggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtga

SEQ ID NO: 186054 - DNA, 5143 bp, Homo sapiens
  Payload ID: 16636
  Gene Symbol: SF3A1
  Gene Name: splicing factor 3a, subunit 1, 120kDa
  Uniprot ID: Q15459
  ENST ID: ENST00000215793
  CDS Start-End: 156-2537
ggtcccggaagtgcgccagtcgtaccttcgcggccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtggggattatttaccctcctccagaggtcagaaatattgttgacaagactgccagctttgtggccagaaacgggcctgaatttgaagctaggatccgacagaacgagatcaacaaccccaagttcaactttctgaaccccaatgacccttaccatgcctactaccgccacaaggtcagcgagttcaaggaagggaaggctcaggagccgtccgccgccatccccaaggtcatgcagcagcagcagcagaccacccagcagcagctgccccagaaggtccaagcccaagtaatccaagagaccatcgtgcccaaagagcctcctcctgagtttgagttcattgctgatcctccctctatctcagccttcgacttggatgtggtgaagctgacggctcagtttgtggccaggaatgggcgccagtttctgacccagctgatgcagaaagagcagcgcaactaccagtttgactttctccgcccacagcacagcctcttcaactacttcacgaagctagtggaacagtacaccaagatcttgattccacccaaaggtttattttcaaagctcaagaaagaggctgaaaacccccgagaagttttggatcaggtgtgttaccgagtggaatgggccaaattccaggaacgtgagaggaagaaggaagaagaggagaaggagaaggagcgggtggcctatgctcagatcgactggcatgattttgtggtggtggaaacagtggacttccaacccaatgagcaagggaacttccctccccccaccacgccagaggagctgggggcccgaatcctcattcaggagcgctatgaaaagtttggggagagtgaggaagttgagatggaggtcgagtctgatgaggaggatgacaaacaggagaaggcggaggagcctccttcccagctggaccaggacacccaagtacaagatatggatgagggttcagatgatgaagaagaagggcagaaagtgcccccacccccagagacacccatgcctccacctctgcccccaactccagaccaagtcattgtccgcaaggattatgatcccaaagcctccaagcccttgcctccagcccctgctccagatgagtatcttgtgtcccccattactggggagaagatccccgccagcaaaatgcaggaacacatgcgcattggacttcttgaccctcgctggctggagcagcgggatcgctccatccgtgagaagcagagcgatgatgaggtgtacgcaccaggtctggatattgagagcagcttgaagcagttggctgagcggcgtactgacatcttcggtgtagaggaaacagccattggtaagaagatcggtgaggaggagatccagaagccagaggaaaaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacaatgccacctccagttcgtactacagttgtctccgcagtacccgtcatgccccggcccccaatggcatctgtggtccggctgcccccaggctcagtgatcgcccccatgccgcccatcatccacgcgcccagaatcaacgtggtgcccatgcctccctcggcccctcctattatggccccccgcccaccccccatgattgtgccaacagcctttgtgcctgctccacctgtggcacctgtcccagctccagccccaatgccccctgtgcatcccccacctcccatggaagatgagcccacctccaaaaaactgaagacagaggacagcctcatgccagaggaggagttcctgcgcagaaacaagggtccagtgtccatcaaagtccaggtgcccaacatgcaggataagacggaatggaaactgaatgggcaggtgctggtcttcaccctcccactcacggaccaggtctctgtcattaaggtgaagattcatgaagccacaggcatgcctgcagggaaacagaagctacagtatgagggtatcttcatcaaagattccaactcactggcttactacaacatggccaatggcgcagtcatccacctggccctcaaggagagaggcgggaggaagaagtagacaagaggaacctgctgtcaagtccctgccattttgcctctcctgtctcccaccccctgccccagacccaggagcccccctgaggctttgccttgcctgcatatttgtttcgctcttactcagtttgggaattcaaattgtcctgcagaggttcattcccctgaccctttccccacattggtaagagtagctgggttttctaagccactctctggaatctctttgtgttagggtctcgatttgaggacattcatttcttcagcagcccattagcaactgagagcccagggatgtcctacaggatagtttcatagtgacaggtggcacttggctaatagaatatggctgatattgtcattaatcattttgtaccttgacatgggttgtctaataaaactcggacccttcttgtgaaatcagttaaataagacttgtctcggtcacctgtgccctgtccagactcgaggcagtggtaacactgcacagtgctatgtggcttctctttgaggatttttgggttttgtaactaaattcttgctgccctcatactttttatgtattagaatcatattcgtattgcccttttaaaacattgggatcctccaaaggcctgccccatgtatttaacagtaatacaggaagcatggcaggcaccatgcaaaccaaggatggatggtgcagtccctgtgtcagtgggcggtggtttcctgctggcctggaatcactcatcacctgattgattggctctgtggtcctgggcaggtgcctcataggtgtgtggatatgatgacgtttctttaaaatgtatgtatttaacaaatacttaattgtattaaggtcatgtaccaaggatttgataaagtttaaataatttactctctacttttatccattttatccattttaactcatgtaatcctcatgtgagtattcctgtttaacacttgagtaaactgaggcacagagaacataagttgcatgccatagtcacacactgtgaaagtgaaaagagaatgtgtgcaaaacacgtcacagtcctggtttctgagtaaaggcaggctgttatctttagaatcaagctatcacagggagataggcaatgctgtgggtgttggaggaaggtgagagcctgttgctaacaatttcctggttttaaagctaaggctgattttattgggaagatctcacatgtgtgtggcccctgagagttcccagtgccttttatttgcagtccttccatttggacctcctagctgccccatcaggtcatctccagggctcagaggggtgagaccatttcccaaggtcacagaaccagctctctagtcaccaccctgcctctccctctcacccagagtcagtaccagttttatggctttattacaaactgctgggtccctcccattttcaacttgattgatgggatgtcatcccttatcctgtctgacatttgcctctggcctggttgctagaagtttgccccaggggcaagagttgaaatttggcttcctgaggtgggctttgtggtttgcgtccctaaagtgagcccactactggttgcttgtccatggccaacaccagaaatcccctgagcactacctgggtctcattccaagaaggaagagggtcaggagacctggggagtctcatattccaagttcttctttctttctgggagcagtgggcagttcatggtgttagggcactcacccccacagactggcaaaccctgcaggacttccgtggctgaggctgtgaccggaggccaggaatgccgttgggtggattgtgagtgaatgggccctttgagctgccctctagagagcaaatccagtttcctggagctcctgaatgaatatctgtactggctcgctcagatgcagaagctccattgaccatgaggccttgtgaacatcagtggccacaggcccagtgtgctgcttggcactgcactagtttaggacctgcagcatgtaggtagcgtcctagtgtttataatacaaagctgctctgcacagcttttctgattcttcttgcaatctcctgaggattatctgccccatttttaaaacgaggtggaatacccaaggtcatgtagccagtgagtgctctggaaagccaaagcagctcatcccttcctggggaccacactgctctgctccaccagaccacactatgaaataggaataagtgctcctgttgcaggactgctgggaaaacaggtggtgtgggacttaagtcaccataattttgaagacttgcatgcagagggctccaggaattgtagacattaaggaatttcactttcagttctacccactacttaagtacttgtcatgtactcttagaggaggccagtaatgatcagaaccattttactttaaaattaataatattgtattagagaatatattaaatggttatattgggttatgttaggatatatacttgaatggaaatacatgtactattagcaatcatatttcatttatccctgtaattagacaagaaagcataatatagctctactcatgggtacacataccagtgtataagatttttagaagtttactttttaaaaataaaagcaaaatgtaagatcttaa

SEQ ID NO: 186055 - DNA, 418 bp, Homo sapiens
  Payload ID: 16636
  Gene Symbol: SF3A1
  Gene Name: splicing factor 3a, subunit 1, 120kDa
  ENST ID: ENST00000447376
  CDS Start-End: 128-319
cgcggccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtggggattatttaccctcctccagaggtcagaaatattgttgacaagactgccagctttgtggccagatcttgattccacccaaaggtttattttcaaagctcaagaaagaggctgaaaacccccgagaagttttggatcaggtgtgttaccgagtggaatgggccaaattcc

SEQ ID NO: 186056 - DNA, 777 bp, Homo sapiens
  Payload ID: 16636
  Gene Symbol: SF3A1
  Gene Name: splicing factor 3a, subunit 1, 120kDa
  ENST ID: ENST00000444440
  CDS Start-End: 1-777
ggggcccgaatcctcattcaggagcgctatgaaaagtttggggagagtgaggaagttgagatggaggtcgagtctgatgaggaggatgacaaacaggagaaggcggaggagcctccttcccagctggaccaggacacccaagtacaagatatggatgagggttcagatgatgaagaagaagggcagaaagtgcccccacccccagagacacccatgcctccacctctgcccccaactccagaccaagtcattgtccgcaaggattatgatcccaaagcctccaagcccttgcctccagcccctgctccagatgagtatcttgtgtcccccattactggggagaagatccccgccagcaaaatgcaggaacacatgcgcattggacttcttgaccctcgctggctggagcagcgggatcgctccatccgtgagaagcagagcgatgatgaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacaatgccacctccagttcgtactacagttgtctccgcagtacccgtcatgccccggcccccaatggcatctgtggtccggctg

SEQ ID NO: 186057 - DNA, 548 bp, Homo sapiens
  Payload ID: 16636
  Gene Symbol: SF3A1
  Gene Name: splicing factor 3a, subunit 1, 120kDa
  ENST ID: ENST00000411423
  CDS Start-End: 93-209
gagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagccattggtaagaagatcggtgaggaggagatccagaagccagaggaaaaggtgacctgggatggccactcaggcagcatggcccggacccagcaggctgcccaggccaacatcaccctccaggagcagattgaggccattcacaaggccaaaggcctggtgccagaggatgacactaaagagaagattggccccagcaagcccaatgaaatccctcaacagccaccgccaccatcttcagccaccaacatccccagctcggctccacccatcacttcagtgccccgaccacccacaatgccacctccagttcgtactacagttgtctccgcagtacccgtcatgccccggcccccaatggcatctgtggtccggctgcccccaggctcagtga

SEQ ID NO: 186058 - DNA, 1963 bp, Homo sapiens
  Payload ID: 16637
  Gene Symbol: SF3A2
  Gene Name: splicing factor 3a, subunit 2, 66kDa
  Uniprot ID: Q15428
  ENST ID: ENST00000221494
  CDS Start-End: 436-1830
cggaccaaggtggaacagaatcaaggcaccccagcgatggctggcacccctttctagagcggccaggcgcaggcggagggagcgataacgtcgcccggagagtgtcagccgctccctcgcgaaagttggccccgtgcggccgcagcggaccgagggttcgttgagagcgttgtgcgcacgcgcagtttgccttccaggccgcgctttcagcctctccccctccagccttttccttcgcgcctcgggaccctctgactcacgccgctgggcgggccaggcatgcgcacaccagagggcccgtctcatttgccccggaagtgctttctttgcccgccgttcgccaaacgaagtcgtggaggtggcgaaacgaggaggagataacgcggccttgggctctggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccagattgactaccctgagatcgccgagggcatcatgccacgtcaccgcttcatgtctgcgtacgagcagaggatcgagcctccggaccggcgctggcagtacctgctcatggccgccgagccctacgagaccattgccttcaaggtgccgagcagagagatcgacaaggcggagggcaagttctggacacactggaaccgggagaccaagcagttcttcctccagttccactttaagatggagaagcccccggctccacccagcctccctgctggcccccctggggtgaagcggcctccacccccgctgatgaacggtctgccccctcggccaccgctgcctgagtctttgccaccgcccccgccaggaggcctgcctctgccacccatgccccccacagggcctgcgccctcagggcccccgggaccaccccagctacccccgccagctccaggggtccaccccccggccccagtggtgcatccccctgcatctggggtccatcccccagctcctggcgtccaccccccagctcctggcgtccatcccccagcccctggggtccacccaccaacctctggggtccaccccccagctcctggagtccaccctccagcccccggggttcacccaccagcccccggagtccacccaccagcccctggggttcacccaccagccccaggggtccatcctcccccatcagcgggggttcacccccaggccccgggggtgcacccagcagcccccgccgttcaccctcaggccccaggggtgcacccaccagccccagggatgcaccctcaggccccgggggtccacccccaacctcccggggtccatccgtcggctcctggggtccaccctcagcctccgggagttcacccctcaaatcctggggtgcaccccccaactcccatgcccccaatgctgaggcccccacttccctccgaaggcccagggaacatacctccccctcccccaaccaactgagaagctgctccctcccccagcaagcccagcgccaggtgctcttgccttttcccactgagagaaggctgctcttttgtactgccccccgctcattaaacagcctcccccagccctgagtgcactgatgtccgca

SEQ ID NO: 186059 - DNA, 543 bp, Homo sapiens
  Payload ID: 16637
  Gene Symbol: SF3A2
  Gene Name: splicing factor 3a, subunit 2, 66kDa
  ENST ID: ENST00000586396
  CDS Start-End: 139-543
cacgttagctggccccattttgcaggtgcaccccgctgtgaccgttgttcttgtgtatccttggacgacaccaaacagccaggcggagctctggaaaataggtgtctcccagtctgctaaagccctaaggccatcaccatggacttccagcatcgccccgggggcaagaccgggagcgggggcgtggcctcctcctccgagagcaaccgtgaccgcagggagcgcctccggcagctggccctggagaccatcgacatcaacaaggacccgtacttcatgaagaaccacctgggctcctatgaatgcaaactctgcctgacacttcacaacaatgaggggagctacctggcacatacgcaggggaagaagcaccagaccaacctggcccggcgagcagccaaggaggccaaggaggcccctgcccagcccgcgcctgagaaggtcaaggtggaggtgaagaagtttgtgaagatcggccgcccgggctacaaagtgaccaagcagagagactcggagatgggccagcagagcctcctcttccag

SEQ ID NO: 186060 - DNA, 3673 bp, Homo sapiens
  Payload ID: 16638
  Gene Symbol: SF3A3
  Gene Name: splicing factor 3a, subunit 3, 60kDa
  Uniprot ID: Q12874
  ENST ID: ENST00000373019
  CDS Start-End: 957-2462
gcagttttagtagagacggggtttcaccgtgttagacaggatggtctcaatctcctgatctcgttggatgcacagtattttatttaacatattcgctgccgatagacaagtcgtttctacacgtgaatttcttttttttttttttttttgagactgagtctcattctgtcgcccaggctggagtgcagtggcacgatctcagctgacggcaacctctgcttcccgggttcaagcgattctcctgcctcagcctccggagtagctgggactacaggcgcctgccatcacgcccggctaatttttgtttgtttgtttttagtagagacggggtttcaccatgttagccagcctggtcgtctcgaacctctgacctcaagtgatccgcccgcctcggcctcccaaagtgttgggattacaggcgtgagctaccgcgcccggcctcacatgtgaatttttttaaaaacaccaccagcaaaaccccactattcccattttcctgagaaagacgctgaggtccagagaaagagaaaacgttctcataatttatgctgaaagctgcgtcctcaagttccggtttcccaactcccatccgcactccaactgctcgcgcagtccacacaggatacctgcccgccaagccggccccagcaagccgcaggaagccgtccgctgaacctcaggttcttgggttttcctatgccccctggaggcatctgcgaacctctcggcatcgctccaccacacctcccaccagcaggtggcactgttgccatctccataacatggactggccttccttgtggtgctcctgttttcttaagtcccggggcacttccggcactcgcggaactttggtgcagcctgatgcgcaacgtggggactcaggcgcgctgggcggcaggagttgcttccggccgtgttggtggtctgaattgagaagccgcgactaagggaagatggagacaatactggagcagcagcggcgctatcatgaggagaaggaacggctcatggacgtcatggctaaagagatgctcaccaagaagtccacgctccgggaccagatcaattctgatcaccgcactcgggccatgcaagataggtatatggaggtcagtgggaacctgagggatttgtatgatgataaggatggattacgaaaggaggagctcaatgccatttcaggacccaatgagtttgctgaattctataatagactcaagcaaataaaggaattccaccggaagcacccaaatgagatctgtgtgccaatgtcagtggaatttgaggaactcctgaaggctcgagagaatccaagtgaagaggcacaaaacttggtggagttcacagatgaagagggatatggtcgttatctcgatctccatgactgttacctcaagtacattaacctgaaggcatctgagaagctggattatatcacatacctgtccatctttgaccaattatttgacattcctaaagaaaggaagaatgcagagtataagagatacctagagatgctgcttgagtaccttcaggattacacagatagagtgaagcctctccaagatcagaatgaactttttgggaagattcaggctgagtttgagaagaaatgggagaatgggacctttcctggatggccgaaagagacaagcagtgccctgacccatgctggagcccatcttgacctctctgcattctcctcctgggaggagttggcttctctgggtttggacagattgaaatctgctctcttagctttaggcttgaaatgtggcgggaccctagaagagcgagcccagagactattcagtaccaaaggaaagtccctggagtcacttgatacctctttgtttgccaaaaatcccaagtcaaagggcaccaagcgagacactgaaaggaacaaagacattgcttttctagaagcccagatctatgaatatgtagagattctcggggaacagcgacatctcactcatgaaaatgtacagcgcaagcaagccaggacaggagaagagcgagaagaagaggaagaagagcagatcagtgagagtgagagtgaagatgaagagaacgagatcatttacaaccccaaaaacctgccacttggctgggatggcaaacctattccctactggctgtataagcttcatggcctaaatatcaactacaactgtgagatttgtggaaactacacctaccgagggcccaaagccttccagcgacactttgctgaatggcgtcatgctcatggcatgaggtgtttgggcatcccaaacactgctcactttgctaatgtgacacagattgaagatgctgtctccttgtgggccaaactgaaattgcagaaggcttcagaacgatggcagcctgacactgaggaagaatatgaagactcaagtgggaatgttgtgaataagaagacatacgaggatctgaaaagacaaggactgctctagtgttcagggatgtagctcagcttttgggctagcccaggcttccctaagatctgctttttctatttctcccaaccaaatcctcttaaagaccctttgctatgtagtctcatggtctagcatgcatcttgtagaaacaaggcatgctggcagattgcagggttgagatgtgttttatctgttttatattttaaaagattctgccagaaaataaaaccagaccttgttctaaagcccagggttatggaccaactcagtgcttcaggtcttaacgcctccatacctcttcctcaccaactttactagtagctgagatttaatgggcacctattatgctacatatcatgttaggtaaatctgacctgacctctttccccaccctcctttgttgctgcttccctgaatgagtattaccccaggatgaggtctgccatcagcttagttagccattgatgcaaatactagggaaagactaggaggatgagccagggttgctactaaggactaagtgtcgcaccaaggtttgccttttgtatttgcataaagaaaggagttggagctgggtgcagtggcttgtgcctgtagtcccagctacttgggaggctgaggcaggagggttgcttgagactagcctaggtaacatagtgagaccctgtctcattaaaaaaaaaaaaaaggcatggtggcacgcactgtagtcccagctactcaggagactgaggctagaagatcctttgaacctaggagtttgagaccagcctgggcgatatagtgaggccccatctcaaaaaaaaaaaaaggggggggggggggagttgggctgtgttggaatgggcctgcagcccaacaaacaagggaactaggaccgacagtgacttcaccagcttgctaggtcagaatgagagactggtgggtctgtctacctgtttcttctacaagatccctatttgactgtaaaagtagctaatactcacatgttctccaatcccaggtagccatggtagagttgggtagagttgagcagctgccccaggatccaaatgtggtgtctgaaatggaaagaactaaggcaaccaggaaggcactgatctgccttataagcacagtcatctgaaagtcaggcctgctgcaggacaggatcccccagagaccccatttgcctctcaacactcagaccttcaactgttttttaataaatctactttttaaaaaaa

SEQ ID NO: 186061 - DNA, 6526 bp, Homo sapiens
  Payload ID: 16639
  Gene Symbol: SF3B1
  Gene Name: splicing factor 3b, subunit 1, 155kDa
  Uniprot ID: O75533
  ENST ID: ENST00000335508
  CDS Start-End: 93-4007
agtgcagcccccagctatttttctccgtggcggcggcgacgagcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggagggaaaacccctgatcctaaaatgaatgctaggacttacatggatgtaatgcgagaacaacacttgactaaagaagaacgagaaattaggcaacagctagcagaaaaagctaaagctggagaactaaaagtcgtcaatggagcagcagcgtcccagcctccatcaaaacgaaaacggcgttgggatcaaacagctgatcagactcctggtgccactcccaaaaaactatcaagttgggatcaggcagagacccctgggcatactccttccttaagatgggatgagacaccaggtcgtgcaaagggaagcgagactcctggagcaaccccaggctcaaaaatatgggatcctacacctagccacacaccagcgggagctgctactcctggacgaggtgatacaccaggccatgcgacaccaggccatggaggcgcaacttccagtgctcgtaaaaacagatgggatgaaacccccaaaacagagagagatactcctgggcatggaagtggatgggctgagactcctcgaacagatcgaggtggagattctattggtgaaacaccgactcctggagccagtaaaagaaaatcacggtgggatgaaacaccagctagtcagatgggtggaagcactccagttctgacccctggaaagacaccaattggcacaccagccatgaacatggctacccctactccaggtcacataatgagtatgactcctgaacagcttcaggcttggcggtgggaaagagaaattgatgagagaaatcgcccactttctgatgaggaattagatgctatgttcccagaaggatataaggtacttcctcctccagctggttatgttcctattcgaactccagctcgaaagctgacagctactccaacacctttgggtggtatgactggtttccacatgcaaactgaagatcgaactatgaaaagtgttaatgaccagccatctggaaatcttccatttttaaaacctgatgatattcaatactttgataaactattggttgatgttgatgaatcaacacttagtccagaagagcaaaaagagagaaaaataatgaagttgcttttaaaaattaagaatggaacaccaccaatgagaaaggctgcattgcgtcagattactgataaagctcgtgaatttggagctggtcctttgtttaatcagattcttcctctgctgatgtctcctacacttgaggatcaagagcgtcatttacttgtgaaagttattgataggatactgtacaaacttgatgacttagttcgtccatatgtgcataagatcctcgtggtcattgaaccgctattgattgatgaagattactatgctagagtggaaggccgagagatcatttctaatttggcaaaggctgctggtctggctactatgatctctaccatgagacctgatatagataacatggatgagtatgtccgtaacacaacagctagagcttttgctgttgtagcctctgccctgggcattccttctttattgcccttcttaaaagctgtgtgcaaaagcaagaagtcctggcaagcgagacacactggtattaagattgtacaacagatagctattcttatgggctgtgccatcttgccacatcttagaagtttagttgaaatcattgaacatggtcttgtggatgagcagcagaaagttcggaccatcagtgctttggccattgctgccttggctgaagcagcaactccttatggtatcgaatcttttgattctgtgttaaagcctttatggaagggtatccgccaacacagaggaaagggtttggctgctttcttgaaggctattgggtatcttattcctcttatggatgcagaatatgccaactactatactagagaagtgatgttaatccttattcgagaattccagtctcctgatgaggaaatgaaaaaaattgtgctgaaggtggtaaaacagtgttgtgggacagatggtgtagaagcaaactacattaaaacagagattcttcctcccttttttaaacacttctggcagcacaggatggctttggatagaagaaattaccgacagttagttgatactactgtggagttggcaaacaaagtaggtgcagcagaaattatatccaggattgtggatgatctgaaagatgaagccgaacagtacagaaaaatggtgatggagacaattgagaaaattatgggtaatttgggagcagcagatattgatcataaacttgaagaacaactgattgatggtattctttatgctttccaagaacagactacagaggactcagtaatgttgaacggctttggcacagtggttaatgctcttggcaaacgagtcaaaccatacttgcctcagatctgtggtacagttttgtggcgtttaaataacaaatctgctaaagttaggcaacaggcagctgacttgatttctcgaactgctgttgtcatgaagacttgtcaagaggaaaaattgatgggacacttgggtgttgtattgtatgagtatttgggtgaagagtaccctgaagtattgggcagcattcttggagcactgaaggccattgtaaatgtcataggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtatttgagacatctcctcatgtaattcaggcagttatgggagccctagagggcctgagagttgctattggaccatgtagaatgttgcaatattgtttacagggtctgtttcacccagcccggaaagtcagagatgtatattggaaaatttacaactccatctacattggttcccaggacgctctcatagcacattacccaagaatctacaacgatgataagaacacctatattcgttatgaacttgactatatcttataattttattgtttattttgtgtttaatgcacagctacttcacaccttaaacttgctttgatttggtgatgtaaacttttaaacattgcagatcagtgtagaactggtcatagaggaagagctagaaatccagtagcatgatttttaaataacctgtctttgtttttgatgttaaacagtaaatgccagtagtgaccaagaacacagtgattatatacactatactggagggatttcatttttaattcatctttatgaagatttagaactcattccttgtgtttaaagggaatgtttaattgagaaataaacatttgtgtacaaaatgctaatttgtgtgtgttttttgaacatgacttgtaaaatgcggaactttgataaagtattggtttatgtggaataagtggcttaatttcattttctgtcacatggtttatagaaagtagttagctgaataaaaactatataaagtgatggcatctttgtcaaaattccattgttgtgttaataatgacagcaagaagagtagcctcaggggatgttcccctcaaactagcacaaccattccatcatcgtagaaaagtagcacttttgctaaactgtcttgaatattttgtacttacatagcgcctttcatctcttgatttctcaaaatgctttatgaacacatttaaagaaagtggtttaagtcttgtccaacacttgacaggtctgctgtgtttagcaagtgaggaatttaactttacttcaaaactgctttctgcctattaggagtgaggatacctaagtaatgctgatagaacaggacaatgttgggcttttctccatgttataagccactactcagcaatgcatcagtaaatacctattcacccactgtatgccagccactgtgcttatatgcaggggatgcaaaggtgcatgagacctgccctctacctttaagaacagtataatggagaaggggagacaaaccttgtgacagattccttatgtactgtgataatacacagtggcagcagctaaaatgtctaggtttgcttagctttgtattcagtaataataagttgatctaagagttcagcataaactgaatgaaatgccatttaatggtagaggaaccaagcattaaggcagtactacacttaattttttaagcaaatatgtaaagtatattttcaaacttttctaatgttatggccccaaatttcttagttttggcctttttactacctatactatttttactgttttgttttgtctccatgtggtagtacttctgtgaactctaaagggaaaaaaaattctgcaagcagcattagtatataactactactgtaagtaaaactgcctattgacactttaggagttcctgcttcagaagcttagttaagaaacagcttgtggccgggtgtggtggctcatgcctgtaatcccagcactttgggaggctgaggcgggcggatcacgaggtcaggagatcgagaccatcctggctaacgcggtgaagtcccgtctactaaaaatacaaaaattagccaggcgtggtggcgggcgcctgtagtcccagctactagggaggctgaggcaggagaatggcttgaacccgggaggcggagcttgcagtgagccgagatagcgctgctacactccagcctgggcgacagagactccgtctcaaaaaaaaaaaaaaaattgactttcaacaaattgatagtgagcattaagggtttccaagttggatttgtaactcctcatcattccttgtatgacaactttctgaatatatgtcactatgtagtaaaattaaacactccaaactcatctttctgttgttagaagttttcagcggtacttccatgcaactttaaatctcactgctctctatggttgatgtcaaatgaccttcagtaatgactgagaattgaatacaaatagattacaaagccaaaatttgatgttaaatgactcaggaaattttagttgtattttcaattcaagtacttagtagcctacgtttgcttggcctctggttctttatggaaaataggctttgtagtggcattgtggagcaaaggagactgttacaccttaattaactttttttactgatgcaaataatttgaggatagagaggagggaagtagtgaaagctatgacctaaaacattgggaccaaatagaggctcacagatatttggattattttatgtgcttattattaaataaggaaagcattttgtgatatgtggaagacgctatgtgaagttttacctatcttctcaaagaccttttcttttgtattttcttttggtgtttcttaaagccaaacaaagaaatgttcttaaggagacagggtgggtttttctgtgggcctttgttggtttttctgtgggccatcgccctctaatggaattgatctctggctgtttgatttttttcatattgtatttttaaaatttgttgtacagtgccctgtgagcaccaagtaccactagatgaataaaacgtattatatctaaa

SEQ ID NO: 186062 - DNA, 593 bp, Homo sapiens
  Payload ID: 16639
  Gene Symbol: SF3B1
  Gene Name: splicing factor 3b, subunit 1, 155kDa
  ENST ID: ENST00000414174
  CDS Start-End: 18-131
gtgttcgagtggacaaaatggcgaagatcgccaagactcacgaagatattgaagcacagattcgagaaattcaaggcaagaaggcagctcttgatgaagctcaaggagtgggcctcgattctacaggatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggtaattctttcccacttttctataagtattcagaaatttatttgtattaagttgtctttagccctttgattttttttggcatgcttctgaatttgcttttctttttaaaaatcccccttactatagatttgtatagatgtggttgaagtcacagatgccatattcttcatctttataatgcaagttttctttccaggtagaaggacaagaaaaaaatgagccaatgccatagaaacgcaaagggtta

SEQ ID NO: 186063 - DNA, 651 bp, Homo sapiens
  Payload ID: 16639
  Gene Symbol: SF3B1
  Gene Name: splicing factor 3b, subunit 1, 155kDa
  Uniprot ID: O75533
  ENST ID: ENST00000414963
  CDS Start-End: 81-515
agctatttttctccgtggcggcggcgacgagcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggcttctattctgctgcttgaagtcagaactgctgatggagacaaaggcacgaaagtgtacgtattccggattagcaacccaggaacccatcacttctgaagactctaaactgtgctgtcattttgtttttatatgcattaaaatatttgttttaaa

SEQ ID NO: 186064 - DNA, 723 bp, Homo sapiens
  Payload ID: 16639
  Gene Symbol: SF3B1
  Gene Name: splicing factor 3b, subunit 1, 155kDa
  ENST ID: ENST00000424674
  CDS Start-End: 1-723
catccaagtatgccctgcattgcagggagactggagatctgtttgttttgcagttaaagggtatgcataagatgactccaccaattaaagatctgctgcctagactcacccccatcttaaagaacagacatgaaaaagtacaagagaattgtattgatcttgttggtcgtattgctgacaggggagctgaatatgtatctgcaagagagtggatgaggatttgctttgagcttttagagctcttaaaagcccacaaaaaggctattcgtagagccacagtcaacacatttggttatattgcaaaggccattggccctcatgatgtattggctacacttctgaacaacctcaaagttcaagaaaggcagaacagagtttgtaccactgtagcaatagctattgttgcagaaacatgttcaccctttacagtactccctgccttaatgaatgaatacagagttcctgaactgaatgttcaaaatggagtgttaaaatcgctttccttcttgtttgaatatattggtgaaatgggaaaagactacatttatgccgtaacaccgttacttgaagatgctttaatggatagagaccttgtacacagacagacggctagtgcagtggtacagcacatgtcacttggggtttatggatttggttgtgaagattcgctgaatcacttgttgaactatgtatggcccaatgtatttgagacatctcctcatg

SEQ ID NO: 186065 - DNA, 2127 bp, Homo sapiens
  Payload ID: 16639
  Gene Symbol: SF3B1
  Gene Name: splicing factor 3b, subunit 1, 155kDa
  ENST ID: ENST00000487698
  CDS Start-End: 81-545
agctatttttctccgtggcggcggcgacgagcggaagttcttgggagcgccagttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggtaattctttcccacttttctataagtattcagaaatttatttgtattaagttgtctttagccctttgattttttttggcatgcttctgaatttgcttttctttttaaaaatcccccttactatagatttgtatagatgtggttgaagtcacagatgccatattcttcatctttataatgcaagttttctttccaggtagaaggacaagaaaaaaatgagccaatgccatagaaacgcaaagggttaaaggttttacttttacttttgttttgggtacgctttctatacttggatcaaatgtatttttctgctcaaaatactttcaaattattgaaagttttcattccaaatcctagatttttaggattgttacccttgagaaactgtttctcacactagagctccccccatagtgctctaaatatagcttagtaaaggcacctactttgctctaagcatacttaaagttaaaacaaaagtatgtatacgaagagtttgatatttttaatagttggagtctgttttgctaattttagtgtgcaagtcagcacaaggggcatagtgagcctgatggaagctttcctcaggtgagtgagtttcacaatcaaaattaggtgcctgtttcttaaaattagattctgctgcaggtttacatactagacttttcagcctgcatgaattagtagggatattctttttttacttgcataattgtaattgatttaaacatgtatgccagaattcacaggcccatactaactgtccttaatttctttcctacagcagtactgctatatgccagtcctgtctgcattcttaagggtgcagttcaacacatcctctctagattatggtgaaaaagtattccaaaggaagtcttatcagagctagtgtcagaaagaatgacactaccaattgggcatgatcttcagcataggaaatgtcttagaattttattattttttcctaaattgtgatgctatactacttgtatagctagttaccacatttctaaagcatagtgtgcctctgtgaatcttgttatatactgtttgggcttctgtaagatattttgaagtttgaaaagcaaatactgaaactttaaccaagagactgacacatctctttgtacaccacgttgcttctgtgtgcatcataataactggtagaagtaatatatttaaagtaatatgtttccagttttaatttatgctttctaagaaataaaaatatgttttctgggtcaacaaaacttaaagcatgaagccctttttagtaacgtgacatcagaataagattataggtatatttttaaaatcagattttctaaactacaattgttttagaacactgtatgaagaacttatctagtcatagttatttgtagtcaggattttaacagcttgcaacaggtaatgttttgaatataaatatctttccaaagtgttactaatggtaaagagataattttctaggcttctattctgctgcttgaagtcagaactgctgatggagacaaaggcacgaaagtgtacgtattccggattagcaacccaggaacccatcacttctgaagactctaaactgtgctgtcattttgtttttatatgcattaaaatatttgttttaaa

SEQ ID NO: 186066 - DNA, 600 bp, Homo sapiens
  Payload ID: 16639
  Gene Symbol: SF3B1
  Gene Name: splicing factor 3b, subunit 1, 155kDa
  Uniprot ID: O75533
  ENST ID: ENST00000409915
  CDS Start-End: 29-463
gttccgtctgtgtgttcgagtggacaaaatggcgaagatcgccaagactcacgaagatattgaagcacagattcgagaaattcaaggcaagaaggcagctcttgatgaagctcaaggagtgggcctcgattctacaggttattatgaccaggaaatttatggtggaagtgacagcagatttgctggatacgtgacatcaattgctgcaactgaacttgaagatgatgacgatgactattcatcatctacgagtttgcttggtcagaagaagccaggatatcatgcccctgtggcattgcttaatgatataccacagtcaacagaacagtatgatccatttgctgagcacagacctccaaagattgcagaccgggaagatgaatacaaaaagcataggcggaccatgataatttccccagagcgtcttgatccttttgcagatggcttctattctgctgcttgaagtcagaactgctgatggagacaaaggcacgaaagtgagggaaaacccctgatcctaaaatgaatgctaggacttacatggatgtaatgcgagaacaacacttgactaaagaagaacgagaaattaggcaacagcta

SEQ ID NO: 186067 - DNA, 2903 bp, Homo sapiens
  Payload ID: 16640
  Gene Symbol: SF3B2
  Gene Name: splicing factor 3b, subunit 2, 145kDa
  Uniprot ID: Q13435
  ENST ID: ENST00000322535
  CDS Start-End: 50-2737
gaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccacccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaagagatgaatatttaacact

SEQ ID NO: 186068 - DNA, 1163 bp, Homo sapiens
  Payload ID: 16640
  Gene Symbol: SF3B2
  Gene Name: splicing factor 3b, subunit 2, 145kDa
  ENST ID: ENST00000530322
  CDS Start-End: 1-1163
cccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccacccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaa

SEQ ID NO: 186069 - DNA, 1081 bp, Homo sapiens
  Payload ID: 16640
  Gene Symbol: SF3B2
  Gene Name: splicing factor 3b, subunit 2, 145kDa
  ENST ID: ENST00000533595
  CDS Start-End: 21-1081
cgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccacccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccg

SEQ ID NO: 186070 - DNA, 3254 bp, Homo sapiens
  Payload ID: 16640
  Gene Symbol: SF3B2
  Gene Name: splicing factor 3b, subunit 2, 145kDa
  ENST ID: ENST00000528302
  CDS Start-End: 55-2691
gccctgaggctggccccagcttccgggttggtcgcgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccacccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcaggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaagagatgaatatttaacactcctgagcctccctcatctccttttagccccttcttgcaaaaggactaaaatagtctctttctacaatcactgggctgccccagtaaccacgaacataaactgggattagacggcgcatttgactggtggtgacgccaaccccaggctgaaatctgtgtttcaccactgccctgctttgtaggaaggcttgggggaagtacctctaggtctggtttgaccttactactttgtccttggggagtaaaaatagccagattagcgccctagcgcggcagaggaagtaacagtgggcttgggaagtaggccagggcaggccttcccaactgaccttgtgaccagaagttcaagtccttacctgtgcgacaacatagctcaaaagctaaattgtcttgagtcc

SEQ ID NO: 186071 - DNA, 841 bp, Homo sapiens
  Payload ID: 16640
  Gene Symbol: SF3B2
  Gene Name: splicing factor 3b, subunit 2, 145kDa
  ENST ID: ENST00000524627
  CDS Start-End: 21-841
cgcgccttcctgcggctaagatggcgacggagcatcccgagcctcccaaagcagaattgcagctgccgccgccgccacctccaggccactatggcgcctgggctgcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccacccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaa

SEQ ID NO: 186072 - DNA, 432 bp, Homo sapiens
  Payload ID: 16640
  Gene Symbol: SF3B2
  Gene Name: splicing factor 3b, subunit 2, 145kDa
  ENST ID: ENST00000524475
  CDS Start-End: 191-432
gaggggcggaggcaggccgctggggcctgacctggccgggctggcctgccccattgatcgtgtactttgccctgcaggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccacccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcg

SEQ ID NO: 186073 - DNA, 1080 bp, Homo sapiens
  Payload ID: 16640
  Gene Symbol: SF3B2
  Gene Name: splicing factor 3b, subunit 2, 145kDa
  ENST ID: ENST00000530981
  CDS Start-End: 1-947
ccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagct

SEQ ID NO: 186074 - DNA, 2817 bp, Homo sapiens
  Payload ID: 16640
  Gene Symbol: SF3B2
  Gene Name: splicing factor 3b, subunit 2, 145kDa
  ENST ID: ENST00000610523
  CDS Start-End: 49-2664
ctcccaaagcagaattgcagctgccgccgccgccacctccaggccactatggcgcctggggcccaggagcttcaggccaagttggcagagatcggagctccgatccagggtaatcgcgaggagctggtggagcggctgcagagctacacccgccagactggcatcgtgctgaatcggccggttttgagaggggaagatggggacaaagccgctccacctcccatgtcggcacagctccctggaattcccatgccaccaccacctttgggactcccccctctgcagcctcctccgccacccccaccacctccaccaggccttggccttggctttcctatggcccacccaccaaatttggggcccccgcctcctctccgtgtgggtgagccagtggcactgtcagaggaggagcggctgaagttggctcagcagcaggcggcattgctgatgcagcaggaggagcgtgccaagcagcagggagatcattcgctgaaggaacatgagctcttggagcagcagaagcgggcagctgtgttactggagcaggaacgacagcaggagattgccaagatgggcaccccagtccctcggcccccacaagacatgggccagattggtgtgcgcactcctctgggtcctcgagtagctgctccagtgggcccagtgggccccactcctacagttttgcccatgggagcccctgttccccggcctcgtggtcccccaccgccccctggagatgagaacagagagatggatgacccctctgtgggccccaagatcccccaggctttggagaagatcctgcagctgaaggagagccgccaggaagagatgaattctcagcaggaggaagaggaaatggaaacagatgctcgctcgtccctgggccagtcagcgtcagagactgaggaggacacagtgtccgtatctaaaaaggagaaaaaccggaagcgtaggaaccgaaagaagaagaaaaagccccagcgggtgcgaggggtgtcctctgagagctctggggaccgggagaaagactcaacccggtcccgtggctctgattccccagcagctgatgttgagattgagtatgtgactgaagaacctgaaatttacgagcccaactttatcttctttaagaggatctttgaggcttttaagctcactgatgatgtgaagaaggagaaagagaaggagccagagaaacttgacaaactggagaactctgcagcccccaagaagaagggatttgaagaggagcacaaggacagtgatgatgacagcagtgatgacgagcaggaaaagaagccagaagcccccaagctgtccaagaagaagttgcgccgaatgaaccgcttcactgtggctgaactcaagcagctggtggctcggcccgatgtcgtggagatgcacgatgtgacagcgcaggaccctaagctcttggttcacctcaaggccactcggaactctgtgcctgtgccacgccactggtgttttaagcgcaaatacctgcagggcaaacggggcattgagaagccccccttcgagctgccagacttcatcaaacgcacaggcatccaggagatgcgagaggccctgcaggagaaggaagaacagaagaccatgaagtcaaaaatgcgagagaaagttcggcctaagatgggcaaaattgacatcgactaccagaaactgcatgatgccttcttcaagtggcagaccaagccaaagctgaccatccatggggacctgtactatgaggggaaggagttcgagacacgactgaaggagaagaagccaggagatctgtctgatgagctaaggatttccttggggatgccagtaggaccaaatgcccacaaggtccctcccccatggctgattgccatgcagcgatatggaccacccccatcgtatcccaacctgaaaatccctgggctgaactcgcccatccctgagagctgttcctttgggtaccatgctggtggctggggcaaacctccagtggatgagactgggaaaccgctctatggggacgtgtttggaaccaatgctgctgaatttcagaccaagactgaggaagaagagattgatcggaccccttggggggaactggaaccatctgatgaagaatcctcagaagaagaggaagaggaagaaagtgatgaagacaaaccagatgagacaggctttattacccctgcagacagtggccttatcactcctggaggcttttcatcagtgcctgctggaatggagacccctgaactcattgagctgaggaagaagaagattgaggaggcgatggacggaagtgagacacctcagctcttcactgtgttgccagagaagagaacagccactgttggaggggccatgatgggatcaacccacatttatgacatgtccacggttatgagccggaagggcccggctcctgagctgcaaggtgtggaagtggcgctggcgcctgaagagttggagctggatcctatggccatgacccagaagtatgaggagcatgtgcgggagcagcaggctcaagtagagaaggaggacttcagtgacatggtggctgagcacgctgccaaacagaagcaaaaaaaacggaaagctcagccccaggacagccgtgggggcagcaagaaatataaggagttcaagttttaggtcccctcacactagccctttttttggccctacgtctggatgcctgggcttcacacaagaaccacctctcccgcagttcccaaggacttgtcatttcatgttcttattttagacctgttttgtaaataaagctgtttcccaaggaaagagatg

SEQ ID NO: 186075 - DNA, 9720 bp, Homo sapiens
  Payload ID: 16641
  Gene Symbol: SF3B3
  Gene Name: splicing factor 3b, subunit 3, 130kDa
  Uniprot ID: Q15393
  ENST ID: ENST00000302516
  CDS Start-End: 212-3865
gcctttttccgccgcgcgccaccagaatgtccctgtcttgaggtctaatggcggacgccagtatgttggagttggtggtggcttaagttttgaagggaggtagcatccgttggatatccacaccatccttctcgctgcaggctttcttggactccgtactgttggtgtaaccaaggcctggaggtctgggtggctcaggtttcctgcagccatgtttctgtacaacttaaccttgcagagagccactggcatcagctttgccattcatggaaacttttctggaaccaaacaacaagaaattgttgtttcccgtgggaagatcttggagctgcttcgcccagaccccaacactggcaaagtacataccctactcactgtggaagtattcggtgttatccggtcactcatggcctttaggctgacaggtggcaccaaagactacattgtagttggcagtgactctggtcgaattgttattttggaataccagccatctaagaatatgtttgagaagattcaccaagaaacctttggcaagagtggatgccgtcgcatcgttcctggccagttcttagctgtggatcccaaagggcgagccgttatgattagtgccattgagaaacagaaattggtgtatattttgaacagagatgctgcagcccgacttaccatttcatctcccctggaagcccacaaagcaaacactttagtgtatcatgtagttggagtagatgtcggatttgaaaatccaatgtttgcttgtctggaaatggattatgaggaagcagacaatgatccaacaggggaagcagcagctaatacccagcagacacttactttctatgagctagaccttggtttaaatcatgtggtccgaaaatacagtgaacctttggaggaacacggcaacttccttattacagttccaggagggtcagatggtccaagtggagtactgatctgctctgaaaactatattacttacaagaactttggtgaccagccagatatccgctgtccaattcccaggaggcggaatgacctggatgaccctgaaagaggaatgatttttgtctgctctgcaacccataaaaccaaatcgatgttcttctttttggctcaaactgagcagggagatatctttaagatcactttggagacagatgaagatatggttactgagatccggctcaaatattttgatactgtacccgttgctgctgccatgtgtgtgcttaaaacagggttcctttttgtagcatcagaatttggaaaccattacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacagaacggtgtgctgctgaggactgtcttggaccctgtcactggggatttgtctgatactcgcactcggtacctggggtcccgtcctgtgaagctcttccgagtccgaatgcaaggccaggaggcagtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtgactggcatccatgtgtcttgttctggagatgaggatgtaggtgggaggtttgaacccaagttagagcaggaagaactgagtagactccttccttccagataccgacttggacttgcggcactctgtggctccccacccccaggtctgtggtggtttctttgttttttcctggttctttttgctgtgctgatgaaacatgacctcaataaccatgtgtatacccacccctcttcccactgggtattgaggaagggtggctgattcttcctcctcttctactctgaggatgttagtatggggattttagcatgaattctagctggggagtcttaacagatgccccttttactgatacagcacctaaagcgatctttggctccataggaccataggaagggtcagtacagaagaacctagatactgccctgcccctgagaactgtgtatatgtggggcctgtctgcagcacccatctcaggtgggttccagagggcctttagggtataatgagagcctgttaggtggaagaggcccagttccagaaatgttccagcccacccctgagaattcctcctgtttagttgtgtgggaagccctcgtcttccaggctgtccttgcgccttgaacctggagaagtgagctcactgttctcaatacttcacaaatgtaaaactttctttcgtctgcatgtgctcagccatctaaattgagcaaatgatctggtgagcactgggttagaatcaggaatggtggaatacaatctgaacctctcagagcccagaacagagggttcctgacactgtgacactgtctcctggaactaagtatctcttgaatcatgacttggttttagatcagtcaagagagacccaggttttgccaggaatcgaatccctaaataacatgtttttttctcacttagctcatgaatttgcatagtagacagtagttctgaattagattttgaaaacctaatttcagggctcattttttcctgtggccctaaatccattctatcaaattgtgtgatactgacatgcagtcatctgaggaactcagcgtagatacttgagcagctcctcgcctcttttctaactcaagtttgactaaaatacatacactccgtacagaaggtagggggttatgtaagaaaggaaaacctaatctatggaatcaggagttgtcaccaccgagcttcctctggaagtctgcccatcagcttgcttgttctctgttaagaggaagggctaggacaaggatttgggcttgaatatgtggaaaggaattttcatagttgttgctgcaggacctacaaaagtttaaaattagattggatgtgactcaatgacaagtcccatctgtgtaattgttaaggggacctgattgactcctgtggtttgattgagcaaccaggtaaatagagacctctctccagctttggcaaaacccatcagaggctgctgcagaactcagacagagggatctgcccttgggtttgcttccatcctgttccattgctaagcccttgtgacttggatcctaggactgaaaagtttttagctgcctcagctttcccctgaccttactggcagaggttctgcagatgtttcctttggaagatctcttgccaagaatagcattcctttggaggaggggggttctagttggaatgttgcttttcttggttagtgtaaatgtattgctagtgagacagctgccggcgctggaaaaggctcgtctcacagggagagtgctggtccccagaatgtgtgctgttcccacgctgctgcctttcttgagcttgttagaggaaagccagaaaggcattcagatgggatcagtctggctttcaaattttttttaattcctaagttctgttttattttttaattttttaaaaaaaattttattagagacagtctctctctcttgcctagctgggagtgcagtggagtgatcatagctcactgaggcttgaactcctgggctcgagcaatccacctcagcctccagagtaggggagactacagatgtgtgccaccatactcagctaatttttaaacttttgtagagacagggtctccctgtgttgcccaggctggcctcgaactcctgacctcaaaaaatcttcctgccttggcctcccaaagcactgggattataggtgtgagccattgcgcctggtcataaattcttgtttttttgtttgtttgtttattagagatggaatctctctctcttgaccaggctagagggctgtggtgcgatctcagcccactgcaacctctatctcctgagctcaagcgatcctccttagcttcccaaatagctggaactacaggcatgtgccatcacgtccagctaatttttgtatttttagtagagaaggttttaccatgttggacagggtggtctcgaactcctggcctaaagtggtccacctagctcagcctaccaaagtgctgtgattacaggcgtgagccaccatgcccagcctctaaattctgttttctattcaaagtaaaaatgacatgtgtttgagtcatccacttgctcatttgcatatggaatattgtatgtgaatattttattacacccttaaaattaattttcaagggctatatgtagagctcagaagaaacatctctgctgctgaaatcaaacctggtccaaaaaacgtcacaacggaggaaaggaatagatggctctcgaggacaagatagggactcttaaaacacctgcttggccatggttgattgacatttgagtgatctggtagcccaacacaccctgtgaagttcaggtgaactgaaatgggcaggtgtaggctacacaccagtctgaaccagcacaaccaagagttgtttctcttttttttctttttctttttcttttttttcttttttttttttttttttttgagatgaagtcttactctgttgcccaggctagagtacagaggcacaatctcggctcaccacagcctccgcctcctgggttcaagcaattctcctgcctcagcctcccaagtagctgggactacaggcatgcaccaccatgcctggctaatttttgtatttttagtagagatggggtttcaccatgttggccaggctggtttcgaactcgtgacctcaggtgatccacccaccttggtctcccaaagcgctgggattacaggcgtgagccactgcacttggccaggagctgtttaagccatcaggagacatgctgacccactagaagaggctgctacgctcatttcttccacaaacgtttactgggcacctaccatgaaccaccacctcccagctctgttctgcacccagaggttggaggagagtttataaccaggcagtctctgtcgctgtgaggttggtggtgaggtgagtctgccagagggcctgccaccagtttcagaagagcctgcagcctgcatctgatttcctcagccacaaccttgggacttcaggaaaaatcagaaggtcccaagtctgaaaaatgaagaggtggggagtgggcagcaggggttttaggtcaggaaatggtaggaaacctgtagttgtggctcataatcctagtgggatattagaaccctcttcatttgtcagaacagattcctggggtctgctcccaattattcacacggtggttcatgcctggtaatcccagcactttgggcggccagaggcaggcagattgcttgagcccagaagtttaagaccagcctaggaaacagaccccatctctacaaaaaattcaaaaagccgggcgtgaagccctgtttttttttttttaaaaaaagagtctgctggtgatgtctgggcatgtgtctgcttcacagtccagtgttatgatcagtagctgtgatggacaatgaacattgctgcttgttcaaaatgaagaaaaaaaatatcaaagaaaaccaggtttggaagtttcagatttggaaaaggagctgggccagcccatctggaatagctgaggggccctgttagccccaccctaccccaccccacccccgtatgcagcatctctggcggtgcccagaggcaagcccccttcagtttcccacctctcactctgccttccagagcctagtcaagttttaaattcccaggtccactcagcagaacttgctcccttctctgactgcagtctcataatgaaaggagaggtgctttcagttgggtcatttggtagcgtttaggcttagaagttactaatttggagccgtgagtatatgtgtataagctagtaacacgtgatggtcaagggaagtactaccatttcctgtgggttattagggcctccagctgttatgaggacacactggggaatctcagctttagggagtcgatgatgtaactggagaaaggcaatgctgccctcataaagcaatcagaaacgagattccacctgccaaatgccaagaggcagcaaagtccatgaagagagcactgtatacagtcagatgacctgggctcactagcctctaagcatagtcttggtttcctgcctgtaaattggtagaataagactgatttactgggcctggcatggtggctcacacctgtaatcccagcactttgagaggctgaggcaggaggatcccttgagcccaggagtttgagaccagcctgggcaacatgacaaaaccccatctctccaaaaatacaaaaattagccaggcatggtggtgcacacttgtagtcccagtaattagggggctgagacaggaggatcacttcagcctatgagtttgaggctgcagtgagctgtgattgcgccactacactccagcctggatgacaggacgaaacctgtctcaaaaacaccaaaaaacaaaaaccggtctcctggggtcatggtagcacaaacgcacatgactgagtgctcaggggttctgaggcttgtccgctgacctggggctctggccctgggagatctgggggacctgctgtcctatatgtgatgctttgaaagaaaggggcatcattccaagccaagaggccccagagagggcaccgtgcggtgttcaggcttctgtgaggccccagtgagatcctgtggctgtgcccccatcacctccacccactctgccctcccactagctgcccaacggatgaatcaacgccttggcagagttttccagcagggccttgcagagagtgtgtgtgacctgtgtggccactgccttggggacgggtgaggagttagcctggaacattccagcgtgggcattattgtcctgttgcaagttcagggcaaaaccaggaatccagttttgtcgatccaattgagaaaacatttcatgaacaactacttgtggcatgcattggcactcggaataaagcgcactattgtcacta

SEQ ID NO: 186076 - DNA, 453 bp, Homo sapiens
  Payload ID: 16641
  Gene Symbol: SF3B3
  Gene Name: splicing factor 3b, subunit 3, 130kDa
  ENST ID: ENST00000566095
  CDS Start-End: 363-453
tttttccgccgcgcgccaccagaatgtccctgtcttgaggtctaatggcggacgccagtatgttggagttggtggtggcttaagttttgaagggaggtagcatccgttggatatccacaccatccttctcgctgcaggtagagacggggtttcactgtgttagccaggatggtctcgatctcctgaccttgatccacccgccttggcctcccaaagtgttgggattacaggtgtgagacaccgcgcccggcccagacgtgggggaagttttaaagcttaccaaatttatctgctttcttggactccgtactgttggtgtaaccaaggcctggaggtctgggtggctcaggtttcctgcagccatgtttctgtacaacttaaccttgcagagagccactggcatcagctttgccattcatggaaacttttctggaaccaaacaacaagaaattg

SEQ ID NO: 186077 - DNA, 529 bp, Homo sapiens
  Payload ID: 16641
  Gene Symbol: SF3B3
  Gene Name: splicing factor 3b, subunit 3, 130kDa
  ENST ID: ENST00000577085
  CDS Start-End: 314-529
aatgtccctgtcttgaggtctaatggcggacgccagtatgttggagttggtggtggcttaagttttgaagggaggtagcatccgttggatatccacaccatccttctcgctgcagggtaaaaaaacagcctggagacttccccgggcccggggaggcggagaccggccatatggaagggggacccgagactttggcgggggtcacgggcagtctaggcccgagaggctggggaccaggaggagctttcttggactccgtactgttggtgtaaccaaggcctggaggtctgggtggctcaggtttcctgcagccatgtttctgtacaacttaaccttgcagagagccactggcatcagctttgccattcatggaaacttttctggaaccaaacaacaagaaattgttgtttcccgtgggaagatcttggagctgcttcgcccagaccccaacactggcaaagtacataccctactcactgtggaagtattcggtgttatccggtcactcatggcctttaggctgacaggt

SEQ ID NO: 186078 - DNA, 551 bp, Homo sapiens
  Payload ID: 16641
  Gene Symbol: SF3B3
  Gene Name: splicing factor 3b, subunit 3, 130kDa
  ENST ID: ENST00000564899
  CDS Start-End: 539-551
gtcgcccagactggagagcagtggcgcgatctcggctcactgccatctctgcctcccgggttccagcgattctcttacctcagcctcccgagtagactagctgggattacgggcgcgtgccaccacgcccggctaatttttctttttttgagacggtgtctcgctttgtcgcccaggctggagtgcagtggcgcgatctctgctcactgcaagctccgctttccgggttcacgccattctcctgcctcagcctcacgagtagctggaactacaggcgcccgccaccgcgcccagctaattttttgtatttttagtagagacggggtttcactgtgttagccaggatggtctcgatctcctgaccttgatccacccgccttggcctcccaaagtgttgggattacaggtgtgagacaccgcgcccggcccagacgtgggggaagttttaaagcttaccaaatttatctgctttcttggactccgtactgttggtgtaaccaaggcctggaggtctgggtggctcaggtttcctgcagccatgtttctgtaca

SEQ ID NO: 186079 - DNA, 630 bp, Homo sapiens
  Payload ID: 16641
  Gene Symbol: SF3B3
  Gene Name: splicing factor 3b, subunit 3, 130kDa
  ENST ID: ENST00000567635
  CDS Start-End: 1-276
gaagaaggagacacattcttttttcagccaagaccacttaaaaaccttgtgctggttgatgagttggacagcctctctcccattctgttttgccagatagctgatctggccaatgaagatactccacagttgtatgtggcctgtggtaggggaccccgatcatctctgagagtcctaagacatggacttgaggtgtcagaaatggctgtttctgagctacctggtaaccccaacgctgtctggacagtgcgtcgacacattgaaggtggctggtgaaggtgctgatcaccacagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatccttcaggacagctgaatgagtacacagaac

SEQ ID NO: 186080 - DNA, 334 bp, Homo sapiens
  Payload ID: 16641
  Gene Symbol: SF3B3
  Gene Name: splicing factor 3b, subunit 3, 130kDa
  ENST ID: ENST00000567654
  CDS Start-End: 162-334
tccgttggatatccacaccatccttctcgctgcagggaaccaaacaacaagaaattgttgtttcccgtgggaagatcttggagctgcttcgcccagaccccaacactggcaaagtacataccctactcactgtggaagtattcggtgttatccggtcactcatggcctttaggctgacaggtggcaccaaagactacattgtagttggcagtgactctggtcgaattgttattttggaataccagccatctaagaatatgtttgagaagattcaccaagaaacctttggcaagagtggatgccgtcgcatcgttcctggccagttcttagctgt

SEQ ID NO: 186081 - DNA, 333 bp, Homo sapiens
  Payload ID: 16641
  Gene Symbol: SF3B3
  Gene Name: splicing factor 3b, subunit 3, 130kDa
  ENST ID: ENST00000569687
  CDS Start-End: 240-333
agatgcatttcctagttcacaaattgtgtaatgattcttgtcagggcacacttttcttggctgcttacctagtgccaagtcgtgtgcctattgctgtaagacatactgagatgtgaaccaaacaacaagaaattgttgtttcccgtgggaagatcttggagctgcttcgcccagaccccaacactggcaaagtacataccctactcactgtggaagtattcggtgttatccggtcactcatggcctttaggctgacaggtggcaccaaagactacattgtagttggcagtgactctggtcgaattgttattttggaataccagccatctaaga

SEQ ID NO: 186082 - DNA, 2085 bp, Homo sapiens
  Payload ID: 16642
  Gene Symbol: SF3B4
  Gene Name: splicing factor 3b, subunit 4, 49kDa
  Uniprot ID: Q15427
  ENST ID: ENST00000271628
  CDS Start-End: 586-1860
atgcaattaggacgaggtgagcgcagacgtcactctaagctcagacatttcgcagtctcctcccctgagggaaaaccaaatacctccagcccaaatcagggttgtgaggccaaatctgcaagaaggctgcaggcgagagggaaggctccctctgcgcctgaaagcccccaagtcctcgggttggggggaactcttcagcacatccttctctggacaacagaagaagaatcactgtccacaaaatatattaaaactgaaatttttgttcttttagctttcgaatttacacttttgagagcagtgtgattctttcaagtctagcagtgcattaagagggcctgagcgtttccgttccgccctcctcgctaagacaactagcagcggcacctcaggacgcgagccgaggactctaccgcccgacccaggttaagtttcggaggctcctaagatggctgcagccgcttccaggcacctcctcttccgcggccccgcccaccgctacgtccgtcttcgccccggaagtggaagtcgtgctgaggtcagaaggcggaaccgctgctgggagacggcgggatctctttcgccatggctgccgggccgatctccgagcggaatcaggatgccactgtgtacgtggggggcctggatgagaaggttagtgaaccgctgctgtgggaactgtttctccaggctggaccagtagtcaacacccacatgccaaaggatagagtcactggccagcaccaaggctatggctttgtggaattcttgagtgaggaagatgctgactatgccattaagatcatgaacatgatcaaactctatgggaagccaatacgggtgaacaaagcatcagctcacaacaaaaacctggatgtaggggccaacattttcattgggaacctggaccctgagattgatgagaagttgctttatgatactttcagcgcctttggggtcatcttacaaacccccaaaattatgcgggaccctgacacaggcaactccaaaggttatgcctttattaattttgcttcatttgatgcttcggatgcagcaattgaagccatgaatgggcagtacctctgtaaccgtcctatcaccgtatcttatgccttcaagaaggactccaagggtgagcgccatggctcagcagccgaacgacttctggcagctcagaacccgctctcccaggctgatcgccctcatcagctgtttgcagatgcacctcctccaccctctgctcccaatcctgtggtatcatcattggggtctgggcttcctccaccaggcatgcctcctcctggctccttcccacccccagtgccacctcctggagccctcccacctgggatacccccagccatgcccccaccacctatgcctcctggggctgcaggacatggccccccatcggcaggaaccccaggggcaggacatcctggtcatggacactcacatcctcacccattcccaccgggtgggatgccccatccagggatgtctcagatgcagcttgcacaccatggccctcatggcttaggacatccccacgctggacccccaggctctgggggccagccaccgccccgaccaccacctggaatgcctcatcctggacctcctccaatgggcatgcccccccgagggcctccattcggatctcccatgggtcacccaggtcctatgcctccgcatggtatgcgtggacctcctccactgatgcccccccatggatacactggccctccacgacccccaccctatggctaccagcgggggcctctccctccacccagacccactccccggccaccagttccccctcgaggcccacttcgaggccctctccctcagtaaattcacattttccttcctcctgttacattttcccaatatcttttctattccttggaccaatcagagatgctgtagctccttggggcaaaggtactaatccctttcagcacccccactccattcccctttttaatgtaactttttccacaggaggtatttcttttttatgttggtcctgagtattttgcaaatgcacagagaaaataaaactaaactccttgttta

SEQ ID NO: 186083 - DNA, 826 bp, Homo sapiens
  Payload ID: 16642
  Gene Symbol: SF3B4
  Gene Name: splicing factor 3b, subunit 4, 49kDa
  ENST ID: ENST00000457312
  CDS Start-End: 256-826
ttgggggcggggtggccgggtgctggctgaggcctctgggtgtgatacttaagtccggtcccctgctgacttctcactcaaaaaatcaaaaaaacccactcacaatactaaattagacttcagaggattcccgaagtcctgggaagagagaagtttaaggatgccactgtgtacgtggggggcctggatgagaaggttagtgaaccgctgctgtgggaactgtttctccaggctggaccagtagtcaacacccacatgccaaaggatagagtcactggccagcaccaaggctatggctttgtggaattcttgagtgaggaagatgctgactatgccattaagatcatgaacatgatcaaactctatgggaagccaatacgggtgaacaaagcatcagctcacaacaaaaacctggatgtaggggccaacattttcattgggaacctggaccctgagattgatgagaagttgctttatgatactttcagcgcctttggggtcatcttacaaacccccaaaattatgcgggaccctgacacaggcaactccaaaggttatgcctttattaattttgcttcatttgatgcttcggatgcagcaattgaagccatgaatgggcagtacctctgtaaccgtcctatcaccgtatcttatgccttcaagaaggactccaagggtgagcgccatggctcagcagccgaacgacttctggcagctcagaacccgctctcccaggctgatcgccctcatcagctgtttgcagatgcacctcctccaccctctgctcccaatcctgtggtatcatcattggggtctgggcttcctc

SEQ ID NO: 186084 - DNA, 693 bp, Homo sapiens
  Payload ID: 16643
  Gene Symbol: SF3B5
  Gene Name: splicing factor 3b, subunit 5, 10kDa
  Uniprot ID: Q9BWJ5
  ENST ID: ENST00000367569
  CDS Start-End: 77-337
actctcctgtaaaacgctagagcggcgagttgttacctgcgtcctctgacctgagagcgaaggggaaagcggcgagatgactgaccgctacaccatccatagccagctggagcacctgcagtccaagtacatcggcacgggccacgccgacaccaccaagtgggagtggctggtgaaccaacaccgcgactcgtactgctcctacatgggccacttcgaccttctcaactacttcgccattgcggagaatgagagcaaagcgcgagtccgcttcaacttgatggaaaagatgcttcagccttgtggaccgccagccgacaagcccgaggagaactgagactctgccttaccaccgcagtgcggggcacctctcccagcgtttctccggtttgccaatcctcttaagtattcctgtctccaaaggaccggctctccatggctcctgcgcctcgtgctttccgcgtacagaagtgcttgcccggggagtcccgcctgacctgccttcatgtggacccttagaacagcactgggagaccagcaggactcctgagaactgtgctggtggagaggtcctagagccggcgagcgtttgagaagagggcatggcgctggagtgagatgggatttggcgtctcgtttttggctaattgattgtcattggctttttccataaagtttagaaatcgttcagtc

SEQ ID NO: 186085 - DNA, 770 bp, Homo sapiens
  Payload ID: 16644
  Gene Symbol: SF3B6
  Gene Name: splicing factor 3b, subunit 6, 14kDa
  Uniprot ID: Q9Y3B4
  ENST ID: ENST00000233468
  CDS Start-End: 215-592
gagtctcgctcaggctcggttttaccccggagtctattcgaagggggctgctacgtcagcgcgtctcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagatggcgatgcaagcggccaagagggcgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaaggaggaacagttgaagcttctcaaggagaaatatggcatcaacacagatccaccaaaataaatgttttctacattttcatttggactaaatcccacgaatgacaactaccacctttttttcctttttaattaatactaaatattgtgatttcttatttgaggttcaaaatgacctgcttgaaactttgatacatattggaatacattatgttaataaacttgtagctttttgtgaaaca

SEQ ID NO: 186086 - DNA, 3747 bp, Homo sapiens
  Payload ID: 16645
  Gene Symbol: SFPQ
  Gene Name: splicing factor proline/glutamine-rich
  Uniprot ID: P23246
  ENST ID: ENST00000357214
  CDS Start-End: 100-2223
gccgcctgtgtcatccgccattttgtgagaagcaaggtggcctccacgtttcctgagcgtcttcttcgcttttgcctcgaccgccccttgaccacagacatgtctcgggatcggttccggagtcgtggcggtggcggtggtggcttccacaggcgtggaggaggcggcggccgcggcggcctccacgacttccgttctccgccgcccggcatgggcctcaatcagaatcgcggccccatgggtcctggcccgggccagagcggccctaagcctccgatcccgccaccgcctccacaccaacagcagcaacagccaccaccgcagcagccaccgccgcagcagccgccaccgcatcagccgccgccgcatccacagccgcatcagcagcagcagccgccgccaccgccgcaggactcttccaagcccgtcgttgctcagggacccggccccgctcccggagtaggcagcgcaccaccagcctccagctcggccccgcccgccactccaccaacctcgggggccccgccagggtccgggccaggcccgactccgaccccgccgcctgcagtcacctcggcccctcccggggcgccgccacccaccccgccaagcagcggggtccctaccacacctcctcaggccggaggcccgccgcctccgcccgcggcagtcccgggcccgggtccagggcctaagcagggcccaggtccgggtggtcccaaaggcggcaaaatgcctggcgggccgaagccaggtggcggcccgggcctaagtacgcctggcggccaccccaagccgccgcatcgaggcggcggggagccccgcgggggccgccagcaccacccgccctaccaccagcagcatcaccaggggcccccgcccggcgggcccggcggccgcagcgaggagaagatctcggactcggaggggtttaaagccaatttgtctctcttgaggaggcctggagagaaaacttacacacagcgatgtcggttgtttgttgggaatctacctgctgatatcacggaggatgaattcaaaagactatttgctaaatatggagaaccaggagaagtttttatcaacaaaggcaaaggattcggatttattaagcttgaatctagagctttggctgaaattgccaaagccgaactggatgatacacccatgagaggtagacagcttcgagttcgctttgccacacatgctgctgccctttctgttcgtaatctttcaccttatgtttccaatgaactgttggaagaagcctttagccaatttggtcctattgaaagggctgttgtaatagtggatgatcgtggaagatctacagggaaaggcattgttgaatttgcttctaagccagcagcaagaaaggcatttgaacgatgcagtgaaggtgttttcttactgacgacaactcctcgtccagtcattgtggaaccacttgaacaactagatgatgaagatggtcttcctgaaaaacttgcccagaagaatccaatgtatcaaaaggagagagaaacccctcctcgttttgcccagcatggcacgtttgagtacgaatattctcagcgatggaagtctttggatgaaatggaaaaacagcaaagggaacaagttgaaaaaaacatgaaagatgcaaaagacaaattggaaagtgaaatggaagatgcctatcatgaacatcaggcaaatcttttgcgccaagatctgatgagacgacaggaagaattaagacgcatggaagaacttcacaatcaagaaatgcagaaacgtaaagaaatgcaattgaggcaagaggaggaacgacgtagaagagaggaagagatgatgattcgtcaacgtgagatggaagaacaaatgaggcgccaaagagaggaaagttacagccgaatgggctacatggatccacgggaaagagacatgcgaatgggtggcggaggagcaatgaacatgggagatccctatggttcaggaggccagaaatttccacctctaggaggtggtggtggcataggttatgaagctaatcctggcgttccaccagcaaccatgagtggttccatgatgggaagtgacatgcgtactgagcgctttgggcagggaggtgcggggcctgtgggtggacagggtcctagaggaatggggcctggaactccagcaggatatggtagagggagagaagagtacgaaggcccaaacaaaaaaccccgattttagatgtgatatttaggctttcattccagtttgttttgtttttttgtttagataccaatcttttaaattcttgcattttagtaagaaagctatctttttatggatgttagcagtttattgacctaatatttgtaaatggtctgtttgggcaggtaaaattatgtaatgcagtgtttggaacaggagaatttttttttcctttttatttctttattttttcttttttactgtataatgtccctcaagtttatggcagtgtaccttgtgccactgaatttccaaagtgtaccaatttttttttttttactgtgcttcaaataaatagaaaaatagttataatattgatcttcaactttgccattcatgcttctatgcatattaggctacgtattccacattgaaagcatgagagtgtctaggcctttgaatggcatatgccatttctgggaaatgcatctggaggctaagtattgctttctacaaataattgccccctttgttttaaaaagaagaaatgcatattgaagtagtttgatgatttgtttggcatataggaagcacgctggtgctaagtattttttaaatggttatgtaagcaaagctgaactgtaaatcttcaggaatatgtattaagattgtggaatgggtgtaagacaattggtagggggtgaaagtgggtttgattaaatggatcttttatggccctatgatctatcctttacttgaaagcttttgaaaagtggaaaggtcattttgttgcatttccccatttcttgtttttaaaagaccaacaaatctcaagccctataaatggcttgtattgaacttttacatttgaattaaagatgttaaacatgaagtcttttcatgtattcaagtgatttataaagatggggtgtagtctaaaaaacaaaacttgaaagtaagaaggtttagtaactgggccgggcgcggtggctcacgcctgtaatcccagcactttgggaggctgaggtgggcaaatcatgagatcaggagttcaagaccagcctggccaacatggtgaaaccccgtctctactaaaaatacaaaaaattagctgggcgtggtggcaggcgcctgtaatcccagctactcgggaggctgagccaggagaattgcttgaacctggagatggaggttgcagtgagctgagactgccactgcactccagcctggacaacagagcgagactctgtctcaaaaaaaaaaaaaggtttagtactgaagtaggtttagttatatatacatttgtactctgtaacttttacatctccttgtgctacttctgttgggcaaaatctataggactataaaaatctattggttctcttctaagagctagtggtgattgttaacaaatagggttgcagataatcattcttattgtaaatttaacttgttttcacatagtttcgttttcatgtagcactaaatctggagaaagttgctcatgctacacagtacaaatatcccttcctcccaccataaaggcttggaatgtttcca

SEQ ID NO: 186087 - DNA, 874 bp, Homo sapiens
  Payload ID: 16645
  Gene Symbol: SFPQ
  Gene Name: splicing factor proline/glutamine-rich
  ENST ID: ENST00000470472
  CDS Start-End: 1-672
gtggaaccacttgaacaactagatgatgaagatggtcttcctgaaaaacttgcccagaagaatccaatgtatcaaaaggagagagaaacccctcctcgttttgcccagcatggcacgtttgagtacgaatattctcagcgatggaagtctttggatgaaatggaaaaacagcaaagggaacaagttgaaaaaaacatgaaagatgcaaaagacaaattggaaagtgaaatggaagatgcctatcatgaacatcaggcaaatcttttgcgccaagatctgatgagacgacaggaagaattaagacgcatggaagaacttcacaatcaagaaatgcagaaacgtaaagaaatgcaattgaggcaagaggaggaacgacgtagaagagaggaagagatgatgattcgtcaacgtgagatggaagaacaaatgaggcgccaaagagaggaaagttacagccgaatgggctacatggatccacgggaaagagacatgcgaatgggtggcggaggagcaatgaacatgggagatccctatggttcaggaggccagaaatttccacctctaggaggtggtggtggcataggttatgaagctaatcctggcgttccaccagcaaccatgagtggttccatgatgggaagtgacatggtaagaatgattgatgttggctgatattggagtgctcattcacatgaagtggatagatacttctcaagacatcacacagcgtgagtcaatcaaggagggaagccacaagcagactgacaacgtttctagcaggatcaggtgagctgtgtccagaaaaccaacgagaaggagtggaaggaggaatgaacgtttcattctcgttaataaaggcattatcctaattatc

SEQ ID NO: 186088 - DNA, 464 bp, Homo sapiens
  Payload ID: 16645
  Gene Symbol: SFPQ
  Gene Name: splicing factor proline/glutamine-rich
  ENST ID: ENST00000460428
  CDS Start-End: 1-265
acgtgagatggaagaacaaatgaggcgccaaagagaggaaagttacagccgaatgggctacatggatccacgggaaagagacatgcgaatgggtggcggaggagcaatgaacatgggagatccctatggttcaggaggccagaaatttccacctctaggaggtggtggtggcataggttatgaagctaatcctggcgttccaccagcaaccatgagtggttccatgatgggaagtgacatggtaagaatgattgatgttggctgatattggagtgctcattcacatgaagtggatagatacttctcaagacatcacacagcgtgagtcaatcaaggagggaagccacaagcagactgacaacgtttctaggatcaggtgagctgtgtccagaaaaccaacgagaaggagtggaaggaggaatgaacgtttcattctcgttaataaaggcattatcctaattatc

SEQ ID NO: 186089 - DNA, 3246 bp, Homo sapiens
  Payload ID: 16646
  Gene Symbol: SFSWAP
  Gene Name: splicing factor, suppressor of white-apricot family
  Uniprot ID: Q12872
  ENST ID: ENST00000261674
  CDS Start-End: 142-2997
cattttgtggcccgctatggcggcggtgttgaggttgggtacgggatgcggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccactaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagtaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgtaaattaatttttgatgacattttgagttttaagatttctgaccagcagtctcttacctgtatatttgtaaatatatcatgtttctgtgaaaatgtattatgaaataaaatgggaggaaacaccttttctagctag

SEQ ID NO: 186090 - DNA, 3219 bp, Homo sapiens
  Payload ID: 16646
  Gene Symbol: SFSWAP
  Gene Name: splicing factor, suppressor of white-apricot family
  Uniprot ID: Q12872
  ENST ID: ENST00000541286
  CDS Start-End: 94-3105
cggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagaggtatttagccttgcatacggacttgcttgaggaggaggcaaggcaagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccactaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgagagtcacagcctccccagggacgctgcgcgcggagccctgtcagagcagcgcgtcagtgacagcggcagccgagccaggaagttatcaggcagcctcgaccaccaccagatttgactccgcgagctcttttgagggaaaacctggtaaaacgtcaaggtcccgctcccggtcccctcggaggagagcccactcccctgagagacggagggaagagaggagtgtgcccactgcctaccgcgtgagccgcagccctggggccagtaggaagcggacccgctccagaagtccccacgagaagaagaagaagaggcggtcccggtcgcggaccaagtccaaggccaggtctcagtcggtgtcacccagcaagcaggcagcgccccggcccgcggcccccgcggcccactcggcgcactcagccagcgtctcccctgtggagagtcggggctccagccaggagcgctccaggggagtctctcaggaaaaagaagcccagatctcttcagcaatcgtttcttccgtgcagagcaaaatcactcaggatctcatggccaaagtcagagcgatgcttgcagcttccaaaaacctgcaaaccagcgcttcctgagacggggccagcggaggcagagccgggaggctgcgtgggcttctgggcaggctcacgcagacgccggccacaccatccacctggccgcctccatggacccttggtggcttttgt

SEQ ID NO: 186091 - DNA, 961 bp, Homo sapiens
  Payload ID: 16646
  Gene Symbol: SFSWAP
  Gene Name: splicing factor, suppressor of white-apricot family
  ENST ID: ENST00000537164
  CDS Start-End: 1-961
cgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccactaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaa

SEQ ID NO: 186092 - DNA, 2636 bp, Homo sapiens
  Payload ID: 16646
  Gene Symbol: SFSWAP
  Gene Name: splicing factor, suppressor of white-apricot family
  ENST ID: ENST00000538548
  CDS Start-End: 141-506
attttgtggcccgctatggcggcggtgttgaggttgggtacgggatgcggggtctttgactgaaggggtaggccaagtggaggtatcagggacgtcgcgcggcacagaagaggaccagcctggacgccggggacgctgtcatgtacggcgcgagcgggggccgcgccaaacccgagaggaaaagcggcgcgaaggaggaggccgggccaggcggtgccggcggtgggggcagccgagtggagctcttggttttcggctatgcctgcaagctgttccgggacgacgagcgggccctggctcaggaacagggacagcacctcatcccctggatgggggaccacaagatcctcatcgacagatatgatggacgtggtcacctgcatgacctttctgagtacgatgctgagtattccacgtggaacagagattatcagctgtctgaagaggaggcgcgaatagaggccctgtgtgatgaagagagaggaagaatacaagcgattgagtgaagcactagcagaggatgggagctacaatgccgtggggttcacttacggtagcgactattacgacccgtcagagccgacggaggaggaggagccttccaaacagagagaaaaaaatgaggccgaaaatttagaggaaaatgaagagcccttcgttgcccccttaggattgagcgtcccgtctgacgtggagttgccaccaaccgctaaaatgcacgccatcatcgagcgcacggccagcttcgtgtgcaggcagggagcacagtttgagatcatgctgaaggccaagcaggcccggaactcccagtttgactttctgcgcttcgaccactacctcaacccctactataagttcatccagaaagccatgaaagagggacgctacactgtcctggcagaaaacaaaagtgacgagaaaaaaaaatcaggagtcagctctgacaatgaagatgatgatgatgaagaagatgggaattaccttcatccctctctctttgcctccaagaagtgtaaccgccttgaagagctgatgaagcccttgaaggtagtggacccagatcatcccctcgcagcacttgttcgtaaggcacaggctgacagttccactcccaccccacacaacgcagacggtgcgcctgtgcagccctcccaggtggagtacacggcagactcgaccgtggcagccatgtattacagctactacatgctaccggacggcacttactgcctggcgccgccccctcccggaatcgacgtgactacttactacagcacccttcctgctggcgtgaccgtgtctaactcccctggagtgacgaccaccgccccaccacctcctgggaccacaccactaccgcccccaaccacagcagagactagcagcggggccacctccacaaccaccaccacaagtgcacttgcccccgtggccgccatcatccccccgccccccgacgtccagcccgtgattgacaagctggccgagtatgtcgccaggaacggcctgaagttcgagaccagtgttcgtgccaagaatgatcaaagatttgagttcctgcagccgtggcaccagtataatgcttattatgagtttaagaagcagttcttcctccagaaagaagggggcgatagcatgcaggctgtgtctgcaccagaagaggctcccacagactctgctcccgagaagccaagtgatgctggggaggatggcgcgcctgaagacgcagccgaggtgggagcacgggcaggctcaggcgggaagaaggaggcatcgtccagtaagaccgtcccggacgggaagctggtgaaagcttcctttgctccaataagctttgcaatcaaggccaaagaaaatgatctgcttcccctggaaaaaaatcgtgttaagctagatgatgacagtgatgatgatgaagaaagcaaagaaggccaagaaagttctagtagtgctgcaaacactaacccagcagttgccccaccctgtgtagttgttgaggagaagaagcctcaacttacccaggaggagctagaagcaaagcaagcaaagcaaaagctggaagatcgcctcgcagctgctgcccgggaaaagctggcccaggcgtctaaggagtcaaaagagaaacagcttcaagcagaacgtaaaaggaaagcggcgttatttttacagaccctcaaaaatcctctgccggaagcagaagctgggaaaattgaggagagtcctttcagtgtcgaggaatccagcactacgccctgccctctactgactggaggcaggcctctgcctactttagaagttaaaccacccgataggccttcgagcaaaagcaaagatccaccgagagaagaagagaaagaaaagaaaaagaaaaagcacaaaaaaagatctcgaacaagatcacgttctcccaagtaccattcgtcatccaagtccaggtctagatcacactcaaaagcaaagcattctcttcccagtgcctatcggacagtgcggcggtcgaggtcccgctcccggtcccctcggaggagagcccactcccctgagagacggagggaagagaggagtgtgcccactgcctaccgcgtgagccgcagccctggggccagtaggaagcggacccgctccaggtaggccac

SEQ ID NO: 186093 - DNA, 6781 bp, Homo sapiens
  Payload ID: 16647
  Gene Symbol: SREK1
  Gene Name: splicing regulatory glutamine/lysine-rich protein 1
  Uniprot ID: Q8WXA9
  ENST ID: ENST00000334121
  CDS Start-End: 160-2034
gggagcaggggagttgtgaaatgggcggctagatctgcccggcgctgtgaattcgccagcgggagcgcgctcgcggccgcgcgttctccgctttcccggctccgtcgctgacgcgtcgtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggacaacgcacctcttgctttttcctccaaagtatgttatgttaagtttcgtgatccatcaagtgttggcgtggcccagcatctaactaacacggtttttattgacagagctctgatagttgttccttgtgcagaaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaagatccaagtttgtactatccctaaagactggagataagcattggaggctcttttaaaaaatgctagttactgaattttgtattgttttacttttttttttatttcaatatatacagtttgatgatgtgcttgaaattggtgcaaatatatacacacccttgtaagtgcaaagtatgtaagaagttttaacatttacttcacaggacttgtgattgtgttaaattctcactattgtgttttcttttgctcactgtttaggacaatttttctttaaaatagttttgcagattaaaattgcttaaataagtggattaaaaaactgacaatgcatgctactgttctctttcaaaaggaagagcaaccgtgttgaatactaataatgatgaattagtattcagtgtttagaatcattgggactacccacaaagtgagcatttctttttaaattttcttgacatttccaagcttattatgaataatattgcagtgtgtcttgtcagctgtaggtggcaaaggtgcccttataaaaaaggaaactggcttttcaaaatgggctatgggagcacaagctgaagctttagtgccttctacaatgtggtatactgttttctagaattttatatgtgctagtcattctcaattcatatggaatctagatggatatttcatgcatacccatagagaagtgtgtaagtgatatgtcagaagagcttcttactgatttcacctaaaatgagaaggaagtcctgttttcaagaatgacattagagtcatgcagctttgggaccatcagttttatactgtgataattgaaaatgaaacatgttcttattttccttaaattgaagaaaaccctttagttgtctacattggatggccttattacctctcaatcatcttttcataaatgatgtgcagaaattgtacttaaggacttaggagtatatgggaggttattggttttatgtttaaggatacgtttacttgagtttaagatacaggtcatccatcattcttaggctcactttttacagaaagtatgcaaatagtaaagtgacagcactgctaatgtttttccccagtactataacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgtgtacattaaaattttggaagatgctttactatgtaaagtatagatggtcattttaatcattcagccacatacggttggctggtaaacagcttattctgatacaagaatgcttgggtgcatatggaaagattgtgaaagagtgtgtcttgcatcaacagctgtcttatttatgatatataagtagaaatagagcaaatgttggaatctgttatttttagtaccatgtctttaataaagctaagtattttagaggaaaatgtttgtttatgcatttcaaaaaagcattttagttttatcctgctcattttagttgtcatagagattgttgtgacgtggagagtgcatgtttgtgtggtgtctataaaacaagtcatttaaagtatgagtgttttcttgtactctggacctattacatgtttctttatgttggtaattaacatttaatttggttcttgctgctaattattttctctgctgatatttattaagctttaaaataatcgtactataatcttgaaacactgatttgtaaaaactaagaatgagtaggaatacaagagatctggaggaacaaatcagattgttattagggtttgactttttttttacatgggcttatggaagcaaggcattctagggtctagagggatgtgtgtgtgtgcttgtgtgtccatgtgtgcgcatgcgcacgtgtgtatctgtttgagacatactttctctgttcacttaaaagagctcatgttttcatttgtttattcttttctttcagggtattttgtttttttctttaagacttctttttttaaatcccaggtagatgttgtcagataaacttgaggtaaggccaagaagacagacattttatgcttcatactttctgtaattatcttttgtagcttgattacatagagtaccctctcttccttaagttgtagttgctatttatcattgtagacaaattctgttgcctttcagcaacgtatgctgaactagtatcataagatggtgcatcagttcataagctagtgcataagttttgtgtcaaaacttttaaatcctgaagttctgcagttatcatcttagttattttctatctaattagcttataattgcaaacactagtcagcttgtgatctctgtgtttcaagttcttttcttcacgaggttcagtacctgctatgttgatctttggcagtgccagaggcttaaattttgacctgctcaattaaaaataaacactggcgtttataatgaaaaggtttttttgtcgggggggggggggtcaagagaatttattttgtgatagtaataattttcaagaccttcagtcattcctatgtctatgttgctatctttattttaaaacttagaaccctgatctaactcccttctcaagtgaagatactgtgtagattcaagaattataatgtagagtaataggcctttaagtttttttttaatctgttagaaataaagagcatgatttaattattgttgaattaacaattaaaatgaatccctttggagggatggcattgaataacttataatttcagtgaatcatttacgttttcattggaagacagtatctgatttcaactggtgcgttacgaagtagagccattcccacaaagtaaatgtgcagtgcccatgtttcttgtgtttaaatattttttattttcactacatatatattattttctcatgtttatttactaatgtaattttcacttaaaattagatgtttattttcaaattttaaaagctagtgctcttaaaagagctaaattatatttctggaagcaggagtttagtataaatgtaataaaattttaaaataaaattgacttccctacttaatcttgggtttgtgggtgagtttgtttttagtacactcttattggtggttttgcctgaagagtaatacattattattattacttttctttttgagacagggtctcactctgtcactcaggctggagtgcagtgacacgatcatggctcactgcaatcttgacctttctcggcatggatgatcctctcacctcagcctcttgaatagctgggaccacagacatgtgccaccaagcccagttaattttagaattttttttgtagagacaggatcttgccatgttgcctagactggtctcaaactcctgggctcaaacaatctgtctgcctcagccttctaaagtgctgagattacaggtgtgaggtactgcacctggcaatacgttattttaaaagtaaacgctaagccatttatgactttggttatattcagtcagttggatttagtaactaataactagctttcttccattctaaggtacttttatagtttctagcaattagtttgttacaattagcttatatcagatataacagttcttaatataatgtttataaaaggttttaagtctgttgcctgatttttaaatttatatctagttaacattttaattttaaaattgccaacttttgggagatttcacatattttacctctatattttatttttccaggattggtatggaggagtagtaccttctattcttggtttatttttatttgctagacataatttcttaactacatatgtaagtataaattcataaaaatcacactgaaagaataggttgatttcaaccattttgagggtactggtaggtaacacactgttggggaataaactaaagaatttctgatttctacaatagatttaagtatgaaatttgagtatactgtgtagctgtgtagatcaacttaatgcttaaaaaattacctccttaatgattagattaatagaacagtgttagattatcaagggaagagtttggaatgtaaacataaacatgctgcataggtggtggttatttgtgagtaggactacttttaaatggtactagtaaagatttatcaaacaatgctgctattatgttgctatatttttaataaaatgaaaatcttaaaatctt

SEQ ID NO: 186094 - DNA, 2433 bp, Homo sapiens
  Payload ID: 16647
  Gene Symbol: SREK1
  Gene Name: splicing regulatory glutamine/lysine-rich protein 1
  Uniprot ID: Q8WXA9
  ENST ID: ENST00000380918
  CDS Start-End: 661-2187
ttatttccccccgaacttaagatggccgcaggtgggcccggaacagccctcatggcaaacgtctcagagcgtttttccactctgaaaatcgcggagaccgcgcctgagccacagtccagtttttaaggccttggtgtcaggccgttttgctgacgagaaagcctgctgctggtgacaagatggaactggggctgtgtttgtttcccaggacggtcgcacaaacttagcattttggtttatctaaccgagcgcatccatgttcccaaagatcatgtctgttagcccttttgacagcagattaaattttcctcctgaaaggtcacactgtcccaaagctttcagaaaaagtcaacgcacctcttgctttttcctccaaagtatgttatgttaagtttcgtgatccatcaagtgttggcgtggcccagcatctaactaacacggtttttattgacagagctctgatagttgttccttgtgcagaagtgatgcagccaacacgaacggttgtcatgtgtaacacaactttcgatcaccgcgaaaacaccgtcctgggaaagcgtccatgcttgatatcgtttggttcatgaacattaagtttccagtacaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctga

SEQ ID NO: 186095 - DNA, 2047 bp, Homo sapiens
  Payload ID: 16647
  Gene Symbol: SREK1
  Gene Name: splicing regulatory glutamine/lysine-rich protein 1
  ENST ID: ENST00000522912
  CDS Start-End: 63-461
ggctccgtcgctgacgcgtcgtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggacaacgcacctcttgctttttcctccaaagtatgttatgttaagtttcgtgatccatcaagtgttggcgtggcccagcatctaactaacacggtttttattgacagagctctgatagttgttccttgtgcagaagtgatgcagccaacacgaacggttgtcatgtgtaacacaactttcgatcaccgcgaaaacaccgtcctgggaaagcgtccatgcttgatatcgtttggttcatgaacattaagtttccagtacaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacag

SEQ ID NO: 186096 - DNA, 580 bp, Homo sapiens
  Payload ID: 16647
  Gene Symbol: SREK1
  Gene Name: splicing regulatory glutamine/lysine-rich protein 1
  ENST ID: ENST00000521691
  CDS Start-End: 353-580
agaactgctctctccaaagtcacctcctggttctcagtctacaacgcacctcttgctttttcctccaaagtatgttatgttaagtttcgtgatccatcaagtgttggcgtggcccagcatctaactaacacggtttttattgacagagctctgatagttgttccttgtgcagaagtgatgcagccaacacgaacggttgtcatgtgtaacacaactttcgatcaccgcgaaaacaccgtcctgggaaagcgtccatgcttgatatcgtttggttcatgaacattaagtttccagtacaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccag

SEQ ID NO: 186097 - DNA, 2172 bp, Homo sapiens
  Payload ID: 16647
  Gene Symbol: SREK1
  Gene Name: splicing regulatory glutamine/lysine-rich protein 1
  ENST ID: ENST00000520953
  CDS Start-End: 63-191
ggctccgtcgctgacgcgtcgtagacgttggggagcgggaaggcaacggcagcgggatcgggatgaacagcggcggcggcttcggtttgggcttaggcttcggcctcacccccacgtcggtgattcagagctctgatagttgttccttgtgcagaagtgatgcagccaacacgaacggttgtcatgtgtaacacaactttcgatcaccgcgaaaacaccgtcctgggaaagcgtccatgcttgatatcgtttggttcatgaacattaagtttccagtacaggtaaaatcccagaggaatccaaagccctctctttattggctcctgctccaaccatgacaagtctgatgcctggtgcaggattgcttccaataccgaccccaaatcctttgactactcttggtgtttcacttagcagtttgggagctataccagcagcagcactagaccccaacattgcaacacttggagagataccacagccaccacttatgggaaacgtggatccttccaaaatagatgaaattaggagaacggtttatgttggaaatctgaattcccagacaacgacagctgatcaactacttgaattttttaaacaagttggagaagtgaagtttgtgcggatggcaggtgatgagactcagccaactcggtttgcttttgtggaatttgcagaccaaaattctgtaccaagggcccttgcttttaatggagttatgtttggagacaggccactgaaaataaatcactccaacaatgcaatagtaaaaccccctgagatgacacctcaggctgcagctaaggagttagaagaagtaatgaagcgagtacgagaagctcagtcatttatctcagcagctattgaaccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacagggaaaaggagagagagagggaaaaggaacgtgaaaaagaaaaggaacggggtaaaaacaaagaccgggacaaggaacgggaaaaggaccgggaaaaagacaaggaaaaggacagagagagagaacgggaaaaagagcatgagaaggatcgagacaaagagaaggaaaaggaacaggacaaagaaaaggaacgagaaaaagacagatccaaagagatagatgaaaaaagaaagaaggataaaaaatccagaacaccacccaggagttacaatgcatcgcgaagatctcgtagttccagcagggaaaggcgtaggaggaggagcaggagttcttccagatcgccaagaacatcaaaaaccataaaaaggaaatcttctagatctccgtcccccaggagcagaaataagaaggataaaaagagagaaaaagaaagggaccacatcagtgaaagaagagagagagaacgttcaacgtctatgagaaagagttctaatgatagagatgggaaggagaagttggagaagaacagtacttcacttaaagagaaagagcacaataaagaaccagattcaagtgtgagcaaagaagtagatgacaaggatgcaccaaggactgaggaaaacaaaatacagcacaatgggaattgtcagctgaatgaagaaaacctctctaccaaaacagaagcagtataggaccgacaagtgtacctctgcactcaatgctggaatcaaatccaaagcttttaattctctcaacaagatgtaaacaggaaagaaatctagttgagcatgaagataggatctaacagcttttccagttgttagatgactttgtggccatcttgttattgagtaagaaaataaagcatggacatcatgaaaataacagatgttacccaaactcatcttctaaaatctgtgcatttccatggtggctgacacacttgtcatgtggtctgttagtgtttgccaagaaccattgcaaataaattgaacatcaaaga

SEQ ID NO: 186098 - DNA, 606 bp, Homo sapiens
  Payload ID: 16647
  Gene Symbol: SREK1
  Gene Name: splicing regulatory glutamine/lysine-rich protein 1
  ENST ID: ENST00000523655
  CDS Start-End: 1-181
aataaatcactccaacaatgcaatagtaaaaccccctgagatgacacctcaggctgcagctaaggagttagaagaagtaatgaagcgagtacgagaagctcagtcatttatctcagcagctattgaaccagggtggctgcactcaacgagtttatgcaatgactttcttggatgtttctgaaggaggaggatgtacagagagtaggccccttgcactatatgtggtacattccacttgtgcctgattattaactgggatctttaattgttctgagcttacactgcaaagtgattttttcctcccagagtctggaaagagcaatgaaagaaaaggcggtcgatctcgttcccatactcgctcaaaatccaggtctagctcaaaatcccattctagaaggaaaagatcacaatcaaaacacaggagtagatcccataatagatcacgttcaagacagaaagacagacgtagatctaagagcccacataaaaaacgctctaaatcaagggagagacggaagtcaaggagtcgttcgcattcacgggacaagagaaaagacactcgagaaaagatcaaggaaaaggaaagagtgaaagagaaagacaggg

SEQ ID NO: 186099 - DNA, 2128 bp, Homo sapiens
  Payload ID: 16647
  Gene Symbol: SREK1
  Gene Name: splicing regulatory glutamine/lysine-rich protein 1
  ENST ID: ENST00000612404
  CDS Start-End: 160-462
gggagcaggggagttgtgaaatgggcggctagatctgcccggcgctgtgaattcgccagcgggagcgcgctcgcggccgcgcgttctccgctttcccggctccgtcgctgacgcgtcgtagacgttggggagcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggacaacgcacctcttgctttttcctccaaagtatgttatgttaagtttcgtgatccatcaagtgttggcgtggcccagcatctaactaacacggtttttattgacagagctctgatagttgttccttgtgcagaagatgactagactggccaaggcagacctgttacacttgcctgagttaggcattgtttgccatgccactaaacctgccgtcaagtgaaaccttcattggggaaatgagatcggagtctgaaccgcagaagatggacgccctgtctctgttttttattgttttactttaatttcatttctttttctttattttgtccctttttttgtttttgtttttgtttttgttttgttaaatctctttcactttaacttgtgagctggttttcccagttctttgtaaatggtatttcattaagggttcataacgtgttgcaaattatattgggagatgattagtagagctcaaccttaagataaagcaaattttcatgtggtaaattaggatacagtgttgtgaagctcattgtgagtcttaatttgtgtgtatggactcataaggtacattttattcttgaaacattaaaacactgataagtatctcaggaacactttctgatctcagcgcaacatttttctagtttttttcccccctagtctacatctctcataaaaactgatagcttctaatttttgtccttccccctggaattttaggcatacaaaatcatcaaggaaaataagtaaatataacaatctgggagtaaagaagagcctttcatttttatgatggttatttatcatataacttatttccttgacttatgaagactttttgttgcctatgtggggaatggatatttgagaaacttaagtatttgcatgtaggtttttgttagcttgaattttttgttgaatatttttcagaggttactagcttctaaatggattctgagattaggactataatactgtgagagatgttttcctcagttgactttgaggagtatagtttgggaaaaatgctaaatgcttatttgttttatacttttataagctctgttatttggagggtaaatttggtagaattctatcttggaaattaagcaatggagctttttcttaaagtacttttgccattacctttaggtaattagaataagtatatagagtaattagaatggtaattgaaagttaatttattaaaaaatgtgcttatagtggatttatacatttatagtagtatactatatttatagtagtatactcttttgaaaggcagtgggagagtttgacaacctactgatacttaagctgaaagtgaaagacttcataatactaagtagtcaacttttggccagtgttgaataccctttttgtttgtatagtctttctacaatgtcttcaataggtagttttacttattaaaggacaagtaatattaaatttgggacattactagattagaactctgagtttccttaggtgcatacattaaggtagtgacgatggagtttctgcctcaaaacctcaatttatcaagaatgttcaggttttacaaaccttttgagataataccaatttataacagataaaacaggtgaaatcaatataaatagtatagtgtatatgtgggtatatataaatacatgtgttaataccaataactaatacatataaagcagattattgttatttgatgttttcagtaaggcctacctgccttttgttgatgcatgttaagaaatctgttctccagaattttcactgaaataataaagataactttgtttttgaaagt

SEQ ID NO: 186100 - DNA, 1314 bp, Homo sapiens
  Payload ID: 16648
  Gene Symbol: SHFM1
  Gene Name: split hand/foot malformation (ectrodactyly) type 1
  Uniprot ID: P60896
  ENST ID: ENST00000248566
  CDS Start-End: 129-341
attctttccccaagtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgagctgaactagagaaacatggttataagatggagacttcatagcatccagaagaagtgttgaagtaacctaaacttgacctgcttaatacattctagggcagagaacccaggatgggacactaaaaaaatgtgtttatttcattatctgcttggatttatttgtgtttttgtaacacaaaaaataaatgttttgatataatcttggtttggttcagaagtcttaatcttttgcttctaatcaattttcttgtcatgattttccaaaaccttattatatatagatagtaaaatttcatattatgaaattttcttttttttttttaatgttaactgagtgaggctcaggttaaatgatctggagtagatttcacctgattcccaattcagtacttttcttaaaccacatcaattaattgttacttctattttataaggaatttcttttacatcacattgaaccttaatctcttctgtattttgatagcttaggcaacatttgctgacatttataaggtgacctttcaaaacctgtgttttaaaaatattaatcattttaaattgctgtaatttacttagttcctgagccattaataatattattaatggttgttagcgtattattggtacttaaagtccaaagtagtttaatcacagtaagaatggtgtcttctattaaaattgaggaagtgggctcaagatactttatcaacaagtgcatattttcaggtactacatagcaggctcatttagtacaactgagttttcacagagtgatagctgttgccacatcacttttgtgaatgggagatttaatttggtttgtaaaggattctttgtgatgacttaaatgtacggggtattttttaggaatattttcaaatgtaaatgttgttactaagaactacaatcaatctgtagtgttgagtaatttcaaatgtaaaatttatgtaacaatgcagtgcagataccaaaataggggttggtggcctgaaatacaagttatacttcaaaatga

SEQ ID NO: 186101 - DNA, 2667 bp, Homo sapiens
  Payload ID: 16648
  Gene Symbol: SHFM1
  Gene Name: split hand/foot malformation (ectrodactyly) type 1
  Uniprot ID: Q6ZVN7
  ENST ID: ENST00000356686
  CDS Start-End: 48-434
gagaaacaaatacatcagatgatgctatgcagctctgaaggaagaacatgtattgccaggactccaacatttgtgctgtgtttgctgtacaaggaggaaaagtgggaagaaagcatggcataaaaagggggaggagacccagcataagaagcccagctcagcgggccagaggaccctggatccatgagagtaagcatccggcctttgcaaagcaacagataaacttggagatgcccaactccagagcgacaacagagttagcctgggtctgcagctccacctcaagaaaaaagaagtgggcaaggtccctgactctttccactgctccactgagccccccaccatccttggtgcactgtgaagattgttcttgcctgcctggctgccattcgggtgacctctacaatctggccccagcagaaagaacttgctagcagcatatcaatagcagagatggaagtctggtcatatggtgcccacatctattgaagtaaacatgctgataccagatatccctggctctctgtcttcaaggcacatggtagaactatacttcctagctttctgtgtggctgggtgggtcacatgacaagttcagacagatgaattatgattagaagcatttaattgttaatacatattctagtgctctttccctctgtcatcacaactgacaatgtttcagacagtgacttctccaacaggctggttccagagtgaaaatagagcccagtagagtctgtagctgatgcaatatggacatgtagggtgagtgagaaaatgcttttgttgggttaagcatctgaggtttgatggtttgttgctactgcagcacaaccttacccatcctaacaaatatgactattattgactaacctgacaacagaagagtctttccacttctgctgtgatgaggaacagagttttttccctgttatatcttaatattagatagcagcagcctctggaaatagttctttctctaccacttcttacccatgtggcataaagccagctactaaacctcttcacttttcagctttcccttttaaaagtgggagtaaataagacctttctcatggagttattgatcaaatgaaataattaaataacgagtatttaaattttaaatttaaatgaaaattcaaatgacataatgcctatgaagtacttatttagtccataatatcctcagtaaatggtagttagccttactaacacaaaggaaatggacaaagccatgccattttccaaagtagtttctaggaccatattatctctaaaaatcccaactttctgctgtaaatttgaactaatccagaacaggctaatccattgcaatggcctattcatccttcttcttagagtttagctatcagtcatcttgttgctgagaacaaagccagcctagttgtttgtaagcaagcctctagagagacagaaactgtcttgtatttctttgaatatcctctactgcctctaacactgtgcctcggctatatttctggatctttatttaattgttttgaatgcttcttatgtttaatttctgccatatccattaggaaaacaacgtaatccttcctccaacaccgatggtataagcctccatgaccgggaaacatttgcccccaagtttaaagaatttagttctgtaaggcttgttgacccatctgacaggaattcctgtaccaagtggtcagtcagtgaagatctctttccactggtaactttatcaagaaagtaagatacaagactgtatgtaaagtatattatcctatgtgaaatcaagggacagaaaataactggaaggaaatattccaaaatgttagcagtagtttctcccggagaatgtgatgtatacatttggatgggtgatatataaagtacttttcatagatctgggcaagagatattttagagggctccacataccacaatcacccacaaataaatgtattaaagagcacacagatgcctttatcactcaggatgtggcactcagagctggcccagcatagtctataacacttaacatcactctcatgaccacactgctcaggtcctagggaagtgtgcctctgtatctcttccctgtatccttaaaagaaaagatgacctaatttgaaagttgataaaaatcagggattatgatgatgttgcttcagaattcttggaggacgtaagagaaaaatagtgctgggttatgagaagaacaaaacttaccaaattcctccctgaagataacataaatgcaatagattcttttacaacaaagtgtcatttctcaataatgccaagaatcctttttcatgcttctcttcttgttcacattcctggttcccatgctactcaattaacataatattcagaaaagttgcagatggtgatttaggaacatgttgtaatattaacatttcatattacccttaaatttgcatgcatgcatcatatgtgtatcatggtaccaattctttatattggtaactaggtggatatagaacatttacaatgtgaatagtgttatctctataaaaacaagatttaattaaaatgttcatatatgaaatgaaattttggcatatattaattataacttggattttaccttttaaagttaatagatcattttgaatattttaaaagactttaataaacatataaaat

SEQ ID NO: 186102 - DNA, 1590 bp, Homo sapiens
  Payload ID: 16648
  Gene Symbol: SHFM1
  Gene Name: split hand/foot malformation (ectrodactyly) type 1
  ENST ID: ENST00000444799
  CDS Start-End: 96-284
gtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgctgtgagaaaaagccctgagctgtctccctaaatggctgtgtctcctgcagtggcttggtaccatcaagtcagatgaaggacacattgggcgaggtgcccatctactgcctggagaacatgcccaggaggctggaacctgttccctttcagagatgaaatcctgtcttctcatcaactcacaagacaaagaggacttttctgacatctagctgaaggagagggattgtttcaagtcttgtgcagcggaatttcccatagtttgttctgttgatccttagtttttcaagatgcccataggaaaaaatatttttgtggtcaagtcagttatggaaacctctgcctttgagctatttatagcttcttaaggcatattagcatgaacatgttctgagacttcctgtgttgaaaagaaactctgtttaactttgtttagcttagtgatttccaaatttgtttgaccacagaacccttttttgggaaacattactaatatttcatggaactagtgggctacagaaaacacatgggatatactgatggacggtgttaggatgatggatcagatggagagtgggaagaacaatggatttaaagtcacagacctatgttcaagtctaatcggctgtttaccaaaaatgcaacattttttagggagatctctaaacctctctcactcttggtttcctcatctaaaaatgggaaataataatatttattacacagggtgtttgtggggatgaaaggacacaatgtggaagaacatgggagcagggcttggttcaacttcaattaaatcagactcttcttgacaagtaaacactgggaccagatgacaatgggatactggcacagaagtgatctgcagaagtcttgttgctgtctacatacacatatgtgttccatgacttcatatattgttggaagtagcagcttattgatggcttggggtatagttgaaaaggataggggcccttctatagcaccaagttggctgtcttcagtgttggtcaagattagctgtcttaaagtccaaaggattggaccggctagatattttgttgtacctcagaaaaattatcttaatttcctagatattttgttgtacctcagaaaaattaccttaattttctaccctctccaaattttttcaccacagaatatttttttggagaaaaattatcaatattttatggaactagtgggctatagaaaacacacaggatgtactgataaaacacagtagtaaaacacattggtttatgaatgatctctgtattaaaccatctgtacatattggtttaataaaagttcattgctagatcta

SEQ ID NO: 186103 - DNA, 699 bp, Homo sapiens
  Payload ID: 16648
  Gene Symbol: SHFM1
  Gene Name: split hand/foot malformation (ectrodactyly) type 1
  ENST ID: ENST00000449279
  CDS Start-End: 118-387
aagtctctatggtagcgtcagcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgggcaactgtactcctgatgatattggtctgtgaaaccccgtatggctgctatgttctccaccaaaagggaagaatgtgcagtgctttcctctgctgttaacagatcatcaacctatgataaaacagagaaaaacagactaagtgatttacttaaggtcacacctctggaaggaccctggtgaccaggtgcctgaccctgtagaagaggaagtgttattgcatcttgcaggggcaggacagaggacagggaaaaggtatgcatatagtatgctaatgaggttatatttccttttggagttagtgtttatcctaagaatcagatttgggatggtgagaagccactattttgttagcttaactagagagtgtccttccagtggtgttattgttgttctttcatactaagtgtttt

SEQ ID NO: 186104 - DNA, 661 bp, Homo sapiens
  Payload ID: 16648
  Gene Symbol: SHFM1
  Gene Name: split hand/foot malformation (ectrodactyly) type 1
  ENST ID: ENST00000413065
  CDS Start-End: 89-358
gcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgggcaactgtactcctgatgatattggtctgtgaaaccccgtatggctgctatgttctccaccaaaagggaagaatgtgcagtgctttcctctgctgttaacagatcatcaacctgtatgtgttcatggccccacctaaatgtaaagagctgggatgcacaggattggagagctattattgagcactagtcatgtggatatgtgcatggagtcagtaaggagggagtggggtggtgctacagcatttcaggcaaagagagcagcctgggtgaaggtccagcctgggcaaggtaggattatggttagcatactgcagtattgttgggtagtaagagattatgatacttcctgtagctacataacaggggcttacttgaagggtgaccctatttattgtttcagtc

SEQ ID NO: 186105 - DNA, 350 bp, Homo sapiens
  Payload ID: 16648
  Gene Symbol: SHFM1
  Gene Name: split hand/foot malformation (ectrodactyly) type 1
  ENST ID: ENST00000417009
  CDS Start-End: 99-296
agcgtcggaggcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgggctggatacagtgaactggaggaatagcggggagaattgccaatactcaggagtcaggcttcacattgatcatgcagctaa

SEQ ID NO: 186106 - DNA, 775 bp, Homo sapiens
  Payload ID: 16648
  Gene Symbol: SHFM1
  Gene Name: split hand/foot malformation (ectrodactyly) type 1
  ENST ID: ENST00000488005
  CDS Start-End: 89-181
gcggtagtgacggtggcgtttccttgaggaagagtgagggttccaacttttctgcttatctgggaggtgttgggcgcggacagtcgagatgtcagagaaaaagcagccggtagacttaggtctgttagaggaagacgacgagtttgaagagttccctgccgaagggcaactgtactcctgatgatattggtctgtgaaaccccgtatggctgctatgttctccaccaaaagggaagaatgtgcagtgctttcctctgctgttaacagatcatcaacctgtatgtgttcatggccccacctaaatgtaaagagctgggatgcacaggattggagagctattattgagcactagtcatgtggatatgtgcatggagtcagtaaggagggagtggggtggtgctacagcatttcaggcaaagagagcagcctgggtgaaggtccagcctgggcaaggtaggattatggttagcatactgcagtattgttgggtagtaagagattatgatacttcctgtagctacataacaggggcttacttgaagggtgaccctatttattgtttcagtcaccagtgttcagtggaaagtcatgtctttcatataaaaaggaggtcaggcacagtggctcatgcctgtaatcccagcactttgggagggcaaggcaggtggatcacctgaggtcaggagttcgagaccagcctggccaacatggtgaaacctgtctctactaaaaatataaaaattagccaggcatggtggtgcatgcctgtaatccc

SEQ ID NO: 186107 - DNA, 462 bp, Homo sapiens
  Payload ID: 16648
  Gene Symbol: SHFM1
  Gene Name: split hand/foot malformation (ectrodactyly) type 1
  ENST ID: ENST00000619259
  CDS Start-End: 13-198
cggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgatcccaaaatgggtaggctctgtttgaccttgtggaattgttgaagatgcagttctcaacagcatcactagatgttagaaacaaatacatcagatgatgctatgcagctctgaaggaagaacatgtattgccaggactccaacatttgtgctgtgtttgctgtacaaggaggaaaagtgggaagaaagcatggcataaaaagggggaggagacccagcataagaagcccagctcagcgggccagaggaccctggatccatgagagtaagcatccggcctt

SEQ ID NO: 186108 - DNA, 2637 bp, Homo sapiens
  Payload ID: 16648
  Gene Symbol: SHFM1
  Gene Name: split hand/foot malformation (ectrodactyly) type 1
  ENST ID: ENST00000615352
  CDS Start-End: 48-404
gagaaacaaatacatcagatgatgctatgcagctctgaaggaagaacatgtattgccaggactccaacatttgtgctgtgtttgctgtacaaggaggaaaagtgggaagaaagcatggcataaaaagggggaggagacccagcataagaagcccagctcagcgggccagaggaccctggatccatgagagtaagcatccggcctttgcaaagcaacagataaacttggagatgcccaactccagagcgacaacagagttagcctgggtctgcaggtccctgactctttccactgctccactgagccccccaccatccttggtgcactgtgaagattgttcttgcctgcctggctgccattcgggtgacctctacaatctggccccagcagaaagaacttgctagcagcatatcaatagcagagatggaagtctggtcatatggtgcccacatctattgaagtaaacatgctgataccagatatccctggctctctgtcttcaaggcacatggtagaactatacttcctagctttctgtgtggctgggtgggtcacatgacaagttcagacagatgaattatgattagaagcatttaattgttaatacatattctagtgctctttccctctgtcatcacaactgacaatgtttcagacagtgacttctccaacaggctggttccagagtgaaaatagagcccagtagagtctgtagctgatgcaatatggacatgtagggtgagtgagaaaatgcttttgttgggttaagcatctgaggtttgatggtttgttgctactgcagcacaaccttacccatcctaacaaatatgactattattgactaacctgacaacagaagagtctttccacttctgctgtgatgaggaacagagttttttccctgttatatcttaatattagatagcagcagcctctggaaatagttctttctctaccacttcttacccatgtggcataaagccagctactaaacctcttcacttttcagctttcccttttaaaagtgggagtaaataagacctttctcatggagttattgatcaaatgaaataattaaataacgagtatttaaattttaaatttaaatgaaaattcaaatgacataatgcctatgaagtacttatttagtccataatatcctcagtaaatggtagttagccttactaacacaaaggaaatggacaaagccatgccattttccaaagtagtttctaggaccatattatctctaaaaatcccaactttctgctgtaaatttgaactaatccagaacaggctaatccattgcaatggcctattcatccttcttcttagagtttagctatcagtcatcttgttgctgagaacaaagccagcctagttgtttgtaagcaagcctctagagagacagaaactgtcttgtatttctttgaatatcctctactgcctctaacactgtgcctcggctatatttctggatctttatttaattgttttgaatgcttcttatgtttaatttctgccatatccattaggaaaacaacgtaatccttcctccaacaccgatggtataagcctccatgaccgggaaacatttgcccccaagtttaaagaatttagttctgtaaggcttgttgacccatctgacaggaattcctgtaccaagtggtcagtcagtgaagatctctttccactggtaactttatcaagaaagtaagatacaagactgtatgtaaagtatattatcctatgtgaaatcaagggacagaaaataactggaaggaaatattccaaaatgttagcagtagtttctcccggagaatgtgatgtatacatttggatgggtgatatataaagtacttttcatagatctgggcaagagatattttagagggctccacataccacaatcacccacaaataaatgtattaaagagcacacagatgcctttatcactcaggatgtggcactcagagctggcccagcatagtctataacacttaacatcactctcatgaccacactgctcaggtcctagggaagtgtgcctctgtatctcttccctgtatccttaaaagaaaagatgacctaatttgaaagttgataaaaatcagggattatgatgatgttgcttcagaattcttggaggacgtaagagaaaaatagtgctgggttatgagaagaacaaaacttaccaaattcctccctgaagataacataaatgcaatagattcttttacaacaaagtgtcatttctcaataatgccaagaatcctttttcatgcttctcttcttgttcacattcctggttcccatgctactcaattaacataatattcagaaaagttgcagatggtgatttaggaacatgttgtaatattaacatttcatattacccttaaatttgcatgcatgcatcatatgtgtatcatggtaccaattctttatattggtaactaggtggatatagaacatttacaatgtgaatagtgttatctctataaaaacaagatttaattaaaatgttcatatatgaaatgaaattttggcatatattaattataacttggattttaccttttaaagttaatagatcattttgaatattttaaaagactttaataaacatataaaat

SEQ ID NO: 186109 - DNA, 507 bp, Homo sapiens
  Payload ID: 16648
  Gene Symbol: SHFM1
  Gene Name: split hand/foot malformation (ectrodactyly) type 1
  ENST ID: ENST00000466986
  CDS Start-End: 50-235
gttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgatcccaaaatgggtaggctctgtttgaccttgtggaattgttgaagatgcagttctcaacagcatcactagatgttgactccaacatttgtgctgtgtttgctgtacaaggaggaaaagtgggaagaaagcatggcataaaaagggggaggagacccagcataagaagcccagctcagcgggccagaggaccctggatccatgagagtaagcatccggcctttgcaaagcaacagataaacttggagatgcccaactccagagcgacaacagagttagcctgggtctg

SEQ ID NO: 186110 - DNA, 610 bp, Homo sapiens
  Payload ID: 16648
  Gene Symbol: SHFM1
  Gene Name: split hand/foot malformation (ectrodactyly) type 1
  ENST ID: ENST00000613919
  CDS Start-End: 13-213
cggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgggatatgggaaacgtgtcaatctctgtgtgagggtgaagaacgcactgagacagccagaagagacatccatggacatgcatcagctggtctccttcaagagaaactcctgggggaggagccaagatggccgaataggaacagctccagtctacagctcccagcgtgagcgacgcagaagatgggtgatttctgcatttccatctgagatcccaaaatgggtaggctctgtttgaccttgtggaattgttgaagatgcagttctcaacagcatcactagatgttgactccaacatttgtgctgtgtttgctgtacaaggaggaaaagtgggaagaaagcatggcataaaaagggggaggagacccagcataagaagcccagctcagcgggccagaggaccctggatccatgagagtaagcatccggcct

SEQ ID NO: 186111 - DNA, 544 bp, Homo sapiens
  Payload ID: 16648
  Gene Symbol: SHFM1
  Gene Name: split hand/foot malformation (ectrodactyly) type 1
  ENST ID: ENST00000618105
  CDS Start-End: 13-282
cggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgccatggacatgcatcagctggtctccttcaagagaaactcctgggggaggagccaagatggccgaataggaacagctccagtctacagctcccagcgtgagcgacgcagaagatgggtgatttctgcatttccatctgagatcccaaaatgggtaggctctgtttgaccttgtggaattgttgaagatgcagttctcaacagcatcactagatgttgactccaacatttgtgctgtgtttgctgtacaaggaggaaaagtgggaagaaagcatggcataaaaagggggaggagacccagcataagaagcccagctcagcgggccagaggaccctggatccatgagagtaagcatccggcctt

SEQ ID NO: 186112 - DNA, 591 bp, Homo sapiens
  Payload ID: 16648
  Gene Symbol: SHFM1
  Gene Name: split hand/foot malformation (ectrodactyly) type 1
  ENST ID: ENST00000617133
  CDS Start-End: 13-189
cggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacggtcctaaactgactctggggactaaagaaaaaaagtataacttatcatggaagttgcttaagtgcaaaattaatcaggtcaggggaggattggatatggagattaaactgtcatgcttggatctggaagatcccaaaatgggtaggctctgtttgaccttgtggaattgttgaagatgcagttctcaacagcatcactagatgttagaaacaaatacatcagatgatgctatgcagctctgaaggaagaacatgtattgccaggactccaacatttgtgctgtgtttgctgtacaaggaggaaaagtgggaagaaagcatggcataaaaagggggaggagacccagcataagaagcccagctcagcgggccagaggaccctggatccatgagagtaagcatccggcctt

SEQ ID NO: 186113 - DNA, 582 bp, Homo sapiens
  Payload ID: 16648
  Gene Symbol: SHFM1
  Gene Name: split hand/foot malformation (ectrodactyly) type 1
  ENST ID: ENST00000623498
  CDS Start-End: 64-237
gaggaagagtgagggttccaacttttctgcttatctgggaggtgttgggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacggtagacacagcatcatctctacccataaaagatggcattctgcaagactgagaagatgcccacctccattcccagagtccaggccttcattaactcacacgagaactacagaagcatcacccctagttctcctattagtcactcctcctcaactgcctctaatccatccatccatctatccggcatgggtcatgtaaagttacagctgagaaggtactccctctcttaaactcatcggggctccatgtggcttcaagattgaaaataaaactactgtgtatggtatataaacttaagctctcaagagtgtgcccactccctgtgctccagtcatggaacactctttgca

SEQ ID NO: 186114 - DNA, 729 bp, Homo sapiens
  Payload ID: 16648
  Gene Symbol: SHFM1
  Gene Name: split hand/foot malformation (ectrodactyly) type 1
  ENST ID: ENST00000623693
  CDS Start-End: 18-380
gggcgcggacagtcgagatgtcagagaaaaagcagccggtagacttaggtctgttagaggaagacgacgagtttgaagagttccctgccgaagactgggctggcttagatgaagatgaagatgcacatgtctgggaggataattgggatgatgacaatgtagaggatgacttctctaatcagttacgacacagcatcatctctacccataaaagatggcattctgcaagactgagaagatgcccacctccattcccagagtccaggccttcattaactcacacgagaactacagaagcatcacccctagttctcctattagtcactcctcctcaactgcctctaatccatccatccatctatccggcatgggtcatgtaaagttacagctgagaaggtactccctctcttaaactcatcggggctccatgtggcttcaagattgaaaataaaactactgtgtatggtatataaacttaagctctcaagagtgtgcccactccctgtgctccagtcatggaacactctttgcagttctttgagcatgctccggtctctctttcatgctttatataagctgtcctcttttattggaacatacttccttcccatcctgcccccaacacccaacttgtctacctgaggagcacttagtcattgttaaagacccagtccaagtttttcctccttggaaatacttccctgacctactttgtctggggtttgtgcc

SEQ ID NO: 186115 - DNA, 1666 bp, Homo sapiens
  Payload ID: 16649
  Gene Symbol: SPO11
  Gene Name: SPO11 meiotic protein covalently bound to DSB
  Uniprot ID: Q9Y5K1
  ENST ID: ENST00000345868
  CDS Start-End: 56-1132
caagggcgcagcctaggacaggggcttctggagcttctggcagccgtctgccctcatggcctttgcacctatggggcccgaggcctcgttcttcgacgttttggaccgacacagggagtccctgctggctgccctgaggagaggtggcagggagcccccaactgggggaagccgcctggcctccaggtttgaagattctgtgggtcttcagatggtatcccattgcaccaccagaaagatcaaaagtgattcaccaaaatcagctcaaaaattttctctaatccttaaaatattgtccatgatttataaattagtacagagcaacacttatgcaaccaaaagggacatatattacactgacagtcaactctttggtaaccagactgtcgtcgacaatattatcaatgacatttcttgcatgttaaaagtgtcaaggaggagtctacatatattatctacatcaaaaggtttaattgctggcaacttaagatacatcgaggaagatggcaccaaagtgaattgtacctgtggtgcaacggctgttgctgtgccatcgaatattcaaggaattcggaatttagttacagatgcaaagtttgtattaattgtagaaaaagatgcaacatttcagcggctcctagatgacaacttttgcaacaaattgtctccttgcatcatgattacgggaaagggagttcctgatctaaacacaagacttttagtcaagaaactgtgggatacatttcatgttcctgttttcactcttgtagatgctgatccacatggcatagaaataatgtgcatctataagtatggatctatgtctatgtcttttgaagctcatcatctcacagttccagctattagatggcttggtcttctcccttctgatcttaaaagattaaatgtacctaaagatagtttgattccactgacaaaaagggaccaaatgaaacttgacagtatcctgaggagaccttatgttacctgccaaccattttggagaaaagaaatggaaataatggcagactctaaaatgaaggcagaaattcaagctttgactttcctatcatcagattatctttccagagtgtacttacctaacaaattaaaatttggaggatggatataaaaataaatcagaagaacttctgattgccagaggcttttcattagttttgttttgattggcaaatactattgtggaaagaacatatattatattcttaattctgtaaaagtgaaataaaataactttccgttaattatatatttttgtcaaaacaaatgctgtactccaattttctttgcaaggccttattcttgcctctatagagacagatttctgtcctatcttctaaagcaaattataaaagaatatgttattttgacctttaaattatttttgaaaaaataatattttatacatgtcatcaaagtctacaaaatatttaccttctacgatacaactaatgttaacgcataaagtatcttactggtaacaaaaatcataatgatctgaatttgagatgttgcaaatgaattgtggtgtccggtagtttcttcttacattttcctttgcctttatactttaggggtcttactccattaattcatttgttacattagtaaaattcagtatgaataaatatttggattgatgtag

SEQ ID NO: 186116 - DNA, 1608 bp, Homo sapiens
  Payload ID: 16649
  Gene Symbol: SPO11
  Gene Name: SPO11 meiotic protein covalently bound to DSB
  ENST ID: ENST00000371260
  CDS Start-End: 10-1074
tctgccctcatggcctttgcacctatggggcccgaggcctcgttcttcgacgttttggaccgacacagggagtccctgctggctgccctgaggagaggtggcagggagcccccaactgggggaagccgcctggcctccaggtttgaagattctgtgggtcttcagatggtatcccattgcaccaccagaaagatcaaaagtgattcaccaaaatcagctcaaaaattttctctaatccttaaaatattgtccatgatttataaattagtacagagcaacacttatgcaaccaaaagggacatatattacactgacagtcaactctttggtaaccagactgtcgtcgacaatattatcaatgacatttcttgcatgttaaaagtgtcaaggaggagtctacatatattatctacatcaaaaggtttaattgctggcaacttaagatacatcgaggaagatggcaccaaagtgaattgtacctgtggtgcaacggctgttgctgtgccatcgaatattcaaggaattcggaatgcaaagtttgtattaattgtagaaaaagatgcaacatttcagcggctcctagatgacaacttttgcaacaaattgtctccttgcatcatgattacgggaaagggagttcctgatctaaacacaagacttttagtcaagaaactgtgggatacatttcatgttcctgttttcactcttgtagatgctgatccacatggcatagaaataatgtgcatctataagtatggatctatgtctatgtcttttgaagctcatcatctcacagttccagctattagatggcttggtcttctcccttctgatcttaaaagattaaatgtacctaaagatagtttgattccactgacaaaaagggaccaaatgaaacttgacagtatcctgaggagaccttatgttacctgccaaccattttggagaaaagaaatggaaataatggcagactctaaaatgaaggcagaaattcaagctttgactttcctatcatcagattatctttccagagtgtacttacctaacaaattaaaatttggaggatggatataaaaataaatcagaagaacttctgattgccagaggcttttcattagttttgttttgattggcaaatactattgtggaaagaacatatattatattcttaattctgtaaaagtgaaataaaataactttccgttaattatatatttttgtcaaaacaaatgctgtactccaattttctttgcaaggccttattcttgcctctatagagacagatttctgtcctatcttctaaagcaaattataaaagaatatgttattttgacctttaaattatttttgaaaaaataatattttatacatgtcatcaaagtctacaaaatatttaccttctacgatacaactaatgttaacgcataaagtatcttactggtaacaaaaatcataatgatctgaatttgagatgttgcaaatgaattgtggtgtccggtagtttcttcttacattttcctttgcctttatactttaggggtcttactccattaattcatttgttacattagtaaaattcagtatgaataaatatttggattgatgtag

SEQ ID NO: 186117 - DNA, 1834 bp, Homo sapiens
  Payload ID: 16649
  Gene Symbol: SPO11
  Gene Name: SPO11 meiotic protein covalently bound to DSB
  Uniprot ID: Q9Y5K1
  ENST ID: ENST00000371263
  CDS Start-End: 110-1300
ggcgtgggcacgccggccgctcagaaagcgcgggaaaggcacgcagccacgccccaagggcgcagcctaggacaggggcttctggagcttctggcagccgtctgccctcatggcctttgcacctatggggcccgaggcctcgttcttcgacgttttggaccgacacagggagtccctgctggctgccctgaggagaggtggcagggagcccccaactgggggaagccgcctggcctccagttctgaggttcttgcatctatagaaaatattatccaagacataatcacaagcttggcaagaaatgaagcacctgcattcacgatagacaacagatcaagctgggaaaacataaagtttgaagattctgtgggtcttcagatggtatcccattgcaccaccagaaagatcaaaagtgattcaccaaaatcagctcaaaaattttctctaatccttaaaatattgtccatgatttataaattagtacagagcaacacttatgcaaccaaaagggacatatattacactgacagtcaactctttggtaaccagactgtcgtcgacaatattatcaatgacatttcttgcatgttaaaagtgtcaaggaggagtctacatatattatctacatcaaaaggtttaattgctggcaacttaagatacatcgaggaagatggcaccaaagtgaattgtacctgtggtgcaacggctgttgctgtgccatcgaatattcaaggaattcggaatttagttacagatgcaaagtttgtattaattgtagaaaaagatgcaacatttcagcggctcctagatgacaacttttgcaacaaattgtctccttgcatcatgattacgggaaagggagttcctgatctaaacacaagacttttagtcaagaaactgtgggatacatttcatgttcctgttttcactcttgtagatgctgatccacatggcatagaaataatgtgcatctataagtatggatctatgtctatgtcttttgaagctcatcatctcacagttccagctattagatggcttggtcttctcccttctgatcttaaaagattaaatgtacctaaagatagtttgattccactgacaaaaagggaccaaatgaaacttgacagtatcctgaggagaccttatgttacctgccaaccattttggagaaaagaaatggaaataatggcagactctaaaatgaaggcagaaattcaagctttgactttcctatcatcagattatctttccagagtgtacttacctaacaaattaaaatttggaggatggatataaaaataaatcagaagaacttctgattgccagaggcttttcattagttttgttttgattggcaaatactattgtggaaagaacatatattatattcttaattctgtaaaagtgaaataaaataactttccgttaattatatatttttgtcaaaacaaatgctgtactccaattttctttgcaaggccttattcttgcctctatagagacagatttctgtcctatcttctaaagcaaattataaaagaatatgttattttgacctttaaattatttttgaaaaaataatattttatacatgtcatcaaagtctacaaaatatttaccttctacgatacaactaatgttaacgcataaagtatcttactggtaacaaaaatcataatgatctgaatttgagatgttgcaaatgaattgtggtgtccggtagtttcttcttacattttcctttgcctttatactttaggggtcttactccattaattcatttgttacattagtaaaattcagtatgaataaatatttggattgatgtag

SEQ ID NO: 186118 - DNA, 810 bp, Homo sapiens
  Payload ID: 16649
  Gene Symbol: SPO11
  Gene Name: SPO11 meiotic protein covalently bound to DSB
  ENST ID: ENST00000418127
  CDS Start-End: 1-810
ctgctggctgccctgaggagaggtggcagggagcccccaactgggggaagccgcctggcctccagttctgaggttcttgcatctatagaaaatattatccaagacataatcacaagcttggcaagaaatgaagcacctgcattcacgatagacaacagatcaagctgggaaaacataaagtttgaagattctgtgggtcttcagatggtatcccattgcaccaccagaaagatcaaaagtgattcaccaaaatcagctcaaaaattttctctaatccttaaaatattgtccatgatttataaattagtacagagcaacacttatgcaaccaaaagggacatatattacactgacagtcaactctttggtaaccagactgtcgtcgacaatattatcaatgacatttcttgcatgttaaaagtgtcaaggaggagtctacatatattatctacatcaaaaggtttaattgctggcaacttaagatacatcgaggaagatggcaccaaagtgaattgtacctgtggtgcaacggctgttgctgtgccatcgaatattcaaggaattcggattacagatgcaaagtttgtattaattgtagaaaaagatgcaacatttcagcggctcctagatgacaacttttgcaacaaattgtctccttgcatcatgattacgggaaagggagttcctgatctaaacacaagacttttagtcaagaaactgtgggatacatttcatgttcctgttttcactcttgtagatgctgatccacatggcatagaaataatgtgcatctataagtatggatctatg

SEQ ID NO: 186119 - DNA, 1133 bp, Homo sapiens
  Payload ID: 16649
  Gene Symbol: SPO11
  Gene Name: SPO11 meiotic protein covalently bound to DSB
  ENST ID: ENST00000494972
  CDS Start-End: 1-372
ttatctacatcaaaaggtttaattgctggcaacttaagatacatcgaggaagatggcaccaaagtgaattgtacctgtggtgcaacggctgttgctgtgccatcgaatattcaaggaattcggaatttagttacagatgcaaagtttgtattaattgtagaaaaagatgcaacatttcagcggctcctagatgacaacttttgcaacaaattgtctccttgcatcatgattacgtcaacaccagtctttcagcacctgaaatccaagggaaagggagttcctgatctaaacacaagacttttagtcaagaaactgtgggatacatttcatgttcctgttttcactcttgtagatgctgatccacatgattaaatgtacctaaagatagtttgattccactgacaaaaagggaccaaatgaaacttgacagtatcctgaggagaccttatgttacctgccaaccattttggagaaaagaaatggaaataatggcagactctaaaatgaaggcagaaattcaagctttgactttcctatcatcagattatctttccagagtgtacttacctaacaaattaaaatttggaggatggatataaaaataaatcagaagaacttctgattgccagaggcttttcattagttttgttttgattggcaaatactattgtggaaagaacatatattatattcttaattctgtaaaagtgaaataaaataactttccgttaattatatatttttgtcaaaacaaatgctgtactccaattttctttgcaaggccttattcttgcctctatagagacagatttctgtcctatcttctaaagcaaattataaaagaatatgttattttgacctttaaattatttttgaaaaaataatattttatacatgtcatcaaagtctacaaaatatttaccttctacgatacaactaatgttaacgcataaagtatcttactggtaacaaaaatcataatgatctgaatttgagatgttgcaaatgaattgtggtgtccggtagtttcttcttacattttcctttgcctttatactttaggggtcttactccattaattcatttgttacattagtaaaattcagtatgaataaatatttggattgatgtag

SEQ ID NO: 186120 - DNA, 2472 bp, Homo sapiens
  Payload ID: 16650
  Gene Symbol: SPOCD1
  Gene Name: SPOC domain containing 1
  Uniprot ID: Q6ZMY3
  ENST ID: ENST00000257100
  CDS Start-End: 201-2291
gatctcagctccttttcagctagtgggtggaaccccaggagggaaaactcagggaagcccaggaggaagtgaaaataccccatggagtgaagcttgtgtgctacctgggttccgggccagtgatccagctcctgggggccatcagccacggccaggcaggggggcagctgccaccaaagctggaggttctagaggacttgatggaggtcagctcaccctcacctgcccagaggctcagaaggaagaaaaggcccatggtgcagggccctgctgggtgccaggttttccagccttctccttcaggaggcacagcaggggaccctggtggcctctctgaccccttctaccctccaagaagcggttccctggcccttggcgaccccagctcggaccctgcatgttcccagagtggcccaatggaggctgaagaggattctcttccggagcagccagaggactcagctcagctccaacaggagaagccatccctgtatattggggtgcggggcactgttgtccgttccatgcaggaggtactatggactcgccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctggtgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctgaccctccttacccaccagaacaggggttttgatgccctcactagtgttgaagcctgttccagagagaggtgggactgcaaggagaggatggtcagccctacccacctgccctgtttgaacttcctgtttgacaatgtttgctgttgattttttgttcaataaagaatttggtaaaattggga

SEQ ID NO: 186121 - DNA, 3960 bp, Homo sapiens
  Payload ID: 16650
  Gene Symbol: SPOCD1
  Gene Name: SPOC domain containing 1
  Uniprot ID: Q6ZMY3
  ENST ID: ENST00000360482
  CDS Start-End: 131-3781
agcaagggcctccctcccccgcatcacgtgatctcagctccttttcagctagtgggtggaaccccaggagggaaaactcagggaagcccagggcccgtgttgtgcttttggcccaggtaggtggacagacatgtcccaggcgggggacgtagaaggccccagcacaggagaccctgtgctcagtccccaacacaactgtgagcttttacagaacatggaaggagccagctccatgccaggcctgtcaccagatgggccgggagcaagctctgggcccggagtcagggctggcagcagaaggaagatccccaggaaggaggcccttcgaggtggcagctcccgggctgcaggtgctgctgaggtccggccaggggtcttggagctgctagctgtggtacagagccggggctcgatgctggctcctgggctccacatgcagctgccctcggtgcctactcaggggagagctctgacctccaagaggctccaggtttctctgtgtgacatcttagatgacagttgccccaggaaactttgtagcaggtctgctggcctcccagagagagctctggcctgcagggagaggcttgcaggagtggaggaggtgagctgcctcaggcccagggaggccagagacggtggaatgagttctccagggtgtgacagaagaagccccacactcagcaaagaggagccccctggaaggcccctgacatcctcaccagacccagtccctgtgagggtaagaaagaaatggaggaggcaaggggctcattcagagtgtgaggaaggggctggtgacttcctgtggcttgatcagagccctcgtggggacaacctcctgtctgtgggagaccctccccaagttgctgacctggagtccttgggaggcccttgcagacctccctctccaaaagacactgggtctgggcctggagagccaggtggaagtggggcaggatgtgcctcagggactgagaaatttggatatttgcccgctacaggggatgggccccagccaggcagcccctgtggccctgtcgggttcccagtgcccagtggaggggagtccctcagttcagctgcacaggctcctccacagagcgcagcactgtgcctgggggcgtcagcacaggcctctgcagagcagcaagaagctgtgtgtgtcgtgcggactggcagcgatgaaggccaggctccagcacaggaccaggaggagctggaggccaaggctcagccagcttccaggggaaggctggagcaaggactcgctgcccccgctgacacctgtgccagctcccgggagcccttgggcggcctcagctcctccctggatactgaagccagcagggcctgctcaggcccattcatggagcagagaagatccaagggcactaagaacctgaagaaaggtccagtgccctgtgcccaagaccggggcacagacagaagctcagacaactcccaccaggacaggccagaggaacccagcccaggaggctgccccagactggaggaagtgaaaataccccatggagtgaagcttgtgtgctacctgggttccgggccagtgatccagctcctgggggccatcagccacggccaggcaggggggcagctgccaccaaagctggaggttctagaggacttgatggaggtcagctcaccctcacctgcccagaggctcagaaggaagaaaaggcccatggtgcagggccctgctgggtgccaggttttccagccttctccttcaggaggcacagcaggggaccctggtggcctctctgaccccttctaccctccaagaagcggttccctggcccttggcgaccccagctcggaccctgcatgttcccagagtggcccaatggaggctgaagaggattctcttccggagcagccagaggactcagctcagctccaacaggagaagccatccctgtatattggggtgcggggcactgttgtccgttccatgcaggaggtactatggactcgccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctggtgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggcctttgggctcttcctgtctcccctctcctttccccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctgaccctccttacccaccagaacaggggttttgatgccctcactagtgttgaagcctgttccagagagaggtgggactgcaaggagaggatggtcagccctacccacctgccctgtttgaacttcctgtttgacaatgtttgctgttgattttttgttcaataaagaatttggtaaaattgg

SEQ ID NO: 186122 - DNA, 2105 bp, Homo sapiens
  Payload ID: 16650
  Gene Symbol: SPOCD1
  Gene Name: SPOC domain containing 1
  ENST ID: ENST00000452755
  CDS Start-End: 60-1979
agttgtgagtaagcctcttattttccctgagccccagtaaccccatccataaaaggagaatgatcctatttcctcctcacggagttggggtgagaataagtaggttcctgcagggaaacacccacgacaggaacaagttggcccagaccctgccgcccacccagctgcctccctctgggactaagtgcctggagagcctcctgggctcagtgcccccgccctgccctggcctccacagccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctgaccctccttacccaccagaacaggggttttgatgccctcactagtgttgaagcctgttccagagagaggtgggactgcaaggagaggatggtcagccctacccacctgccctgtttgaacttcctgt

SEQ ID NO: 186123 - DNA, 487 bp, Homo sapiens
  Payload ID: 16650
  Gene Symbol: SPOCD1
  Gene Name: SPOC domain containing 1
  ENST ID: ENST00000528791
  CDS Start-End: 226-487
gatctcagctccttttcagctagtgggtggaaccccaggagggaaaactcagggaagcccagggcccgtgttgtgcttttggcccaggaggaagtgaaaataccccatggagtgaagcttgtgtgctacctgggttccgggccagtgatccagctcctgggggccatcagccacggccaggcaggggggcagctgccaccaaagctggaggttctagaggacttgatggaggtcagctcaccctcacctgcccagaggctcagaaggaagaaaaggcccatggtgcagggccctgctgggtgccaggttttccagccttctccttcaggaggcacagcaggggaccctggtggcctctctgaccccttctaccctccaagaagcggttccctggcccttggcgaccccagctcggaccctgcatgttcccagagtggcccaatggaggctgaagaggattctcttccggagcagccagaggactcag

SEQ ID NO: 186124 - DNA, 3774 bp, Homo sapiens
  Payload ID: 16650
  Gene Symbol: SPOCD1
  Gene Name: SPOC domain containing 1
  Uniprot ID: Q6ZMY3
  ENST ID: ENST00000533231
  CDS Start-End: 43-3654
cagggcccgtgttgtgcttttggcccaggtaggtggacagacatgtcccaggcgggggacgtagaaggccccagcacaggagaccctgtgctcagtccccaacacaactgtgagcttttacagaacatggaaggagccagctccatgccaggcctgtcaccagatgggccgggagcaagctctgggcccggagtcagggctggcagcagaaggaagatccccaggaaggaggcccttcgaggtggcagctcccgggctgcaggtgctgctgaggtccggccaggggtcttggagctgctagctgtggtacagagccggggctcgatgctggctcctgggctccacatgcagctgccctcggtgcctactcaggggagagctctgacctccaagaggctccaggtttctctgtgtgacatcttagatgacagttgccccaggaaactttgtagcaggtctgctggcctcccagagagagctctggcctgcagggagaggcttgcaggagtggaggaggtgagctgcctcaggcccagggaggccagagacggtggaatgagttctccagggtgtgacagaagaagccccacactcagcaaagaggagccccctggaaggcccctgacatcctcaccagacccagtccctgtgagggtaagaaagaaatggaggaggcaaggggctcattcagagtgtgaggaaggggctggtgacttcctgtggcttgatcagagccctcgtggggacaacctcctgtctgtgggagaccctccccaagttgctgacctggagtccttgggaggcccttgcagacctccctctccaaaagacactgggtctgggcctggagagccaggtggaagtggggcaggatgtgcctcagggactgagaaatttggatatttgcccgctacaggggatgggccccagccaggcagcccctgtggccctgtcgggttcccagtgcccagtggaggggagtccctcagttcagctgcacaggctcctccacagagcgcagcactgtgcctgggggcgtcagcacaggcctctgcagagcagcaagaagctgtgtgtgtcgtgcggactggcagcgatgaaggccaggctccagcacaggaccaggaggagctggaggccaaggctcagccagcttccaggggaaggctggagcaaggactcgctgcccccgctgacacctgtgccagctcccgggagcccttgggcggcctcagctcctccctggatactgaagccagcagggcctgctcaggcccattcatggagcagagaagatccaagggcactaagaacctgaagaaaggtccagtgccctgtgcccaagaccggggcacagacagaagctcagacaactcccaccaggacaggccagaggaacccagcccaggaggctgccccagactggaggaagtgaaaataccccatggagtgaagcttgtgtgctacctgggttccgggccagtgatccagctcctgggggccatcagccacggccaggcaggggggcagctgccaccaaagctggaggttctagaggacttgatggaggtcagctcaccctcacctgcccagaggctcagaaggaagaaaaggcccatggtgcagggccctgctgggtgccaggttttccagccttctccttcaggaggcacagcaggggaccctggtggcctctctgaccccttctaccctccaagaagcggttccctggcccttggcgaccccagctcggaccctgcatgttcccagagtggcccaatggaggctgaagaggattctcttccggagcagccagaggactcagctcagctccaacaggagaagccatccctgtatattggggtgcggggcactgttgtccgttccatgcaggaggtactatggactcgccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctggtgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctgaccctccttacccaccagaacaggggttttgatgccctcactagtgttgaagcctgttccagagagaggtgggactgcaaggagaggatggtcagccctacccacctgccctgtttgaact

SEQ ID NO: 186125 - DNA, 477 bp, Homo sapiens
  Payload ID: 16650
  Gene Symbol: SPOCD1
  Gene Name: SPOC domain containing 1
  ENST ID: ENST00000525930
  CDS Start-End: 416-477
tctcagctccttttcagctagtgggtggaaccccaggagggaaaactcagggaagcccaggtgagagcgacgcgaccgatggggcccggatttcttggatgctgggggactgtcccagtaaggcttgggaacctgggtggggcgcctttcagaacgggaccgatgggagagagacgagaagggttatgggcacgaaccccgttcagtatctgctccttgcgcagtgtgagaactgggagagagactcctggcccttccacttcctgtgcttccttgggaggaagtgaaaataccccatggagtgaagcttgtgtgctacctgggttccgggccagtgatccagctcctgggggccatcagccacggccaggcaggggggcagctgccaccaaagctggaggttctagaggacttgatggaggtcagctcaccctcacctgcccagaggctcagaaggaagaaaaggcccatggtgca

SEQ ID NO: 186126 - DNA, 765 bp, Homo sapiens
  Payload ID: 16650
  Gene Symbol: SPOCD1
  Gene Name: SPOC domain containing 1
  ENST ID: ENST00000528579
  CDS Start-End: 1-765
acgacaggaacaagttggcccagaccctgccgcccacccagctgcctccctctgggactaagtgcctggagagcctcctgggctcagtgcccccgccctgccctggcctccacagccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggcca

SEQ ID NO: 186127 - DNA, 563 bp, Homo sapiens
  Payload ID: 16650
  Gene Symbol: SPOCD1
  Gene Name: SPOC domain containing 1
  ENST ID: ENST00000529396
  CDS Start-End: 434-563
tagtgggtggaaccccaggagggaaaactcagggaagcccaggtgagagcgacgcgaccgatggggcccggatttcttggatgctgggggactgtcccagtaaggcttgggaacctgggtggggcgcctttcagaacgggaccgatgggagagagacgagaagggttatgggcacgaaccccgttcagtatctgctccttgcgcagtgtgagaactgggagagagactcctggcccttccacttcctgtgcttccttgggaagtgaaaataccccatggagtgaagcttgtgtgctacgttttccagccttctccttcaggaggcacagcaggggaccctggtggcctctctgaccccttctaccctccaagaagcggttccctggcccttggcgaccccagctcggaccctgcatgttcccagagtggcccaatggaggctgaagaggattctcttccggagcagccagaggactcagctcagctccaacaggagaagccatccctgtatattggggtgcggggcactgttgtccgttccatgcaggaggtactatggactc

SEQ ID NO: 186128 - DNA, 4837 bp, Homo sapiens
  Payload ID: 16651
  Gene Symbol: SPON1
  Gene Name: spondin 1, extracellular matrix protein
  Uniprot ID: Q9HCB6
  ENST ID: ENST00000576479
  CDS Start-End: 217-2640
gcgctgctctcgttcgcttggctcagctcagctcagctcagcgcagctccgcggccgccaagccgaggcgggcacggtctccgagtcgcggacgccagctccgagctccctctctccgccgcgcctccgccaggtcgcgccttcgtcgggaccacttcgggcaggagtcgcgtggcgaaggcctgcggccgcggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaagtcctcatgtagaagcacccacttttgcaatgttgttctaagctatctatctaactctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaatgaaatttgtttggacttccacttgagacagtaaagagagtattagacacccagtaaaaactgccatataaagaa

SEQ ID NO: 186129 - DNA, 1869 bp, Homo sapiens
  Payload ID: 16652
  Gene Symbol: SPON2
  Gene Name: spondin 2, extracellular matrix protein
  Uniprot ID: Q9BUD6
  ENST ID: ENST00000290902
  CDS Start-End: 334-1329
gacagggaggggaggggagggataggacagacagacaaagaaaggggtgcggcagcactgccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgcggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaa

SEQ ID NO: 186130 - DNA, 1802 bp, Homo sapiens
  Payload ID: 16652
  Gene Symbol: SPON2
  Gene Name: spondin 2, extracellular matrix protein
  Uniprot ID: Q9BUD6
  ENST ID: ENST00000431380
  CDS Start-End: 272-1267
gatgcctgcgccgggagccaggagcttccccagccacttccagcatgtagactgaagtcaggccacgcacagggctctccaggtcacaccctgcgcaagaaggtgtagcacgctggctctaatttcgagaaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgcggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctc

SEQ ID NO: 186131 - DNA, 549 bp, Homo sapiens
  Payload ID: 16652
  Gene Symbol: SPON2
  Gene Name: spondin 2, extracellular matrix protein
  ENST ID: ENST00000509233
  CDS Start-End: 500-549
agagaaacccaagagcagctgcatgagccctcccaggcctacccccgcagccggcactccctgcagcaaagaaaaccatctggccactgggccctgagcccggcgcccggaggaggacctctgccccgctgagcagctctgctccccaggctggccctgggcctctcgcggcctgacccgctccccttggcatcaagcaccaggagggacggggtggcccggccagggcgtgggtgttccccggcccctctgagcaccagcacctgtttcctcactgcttggaggaagatgagaattctcagaggtccttatgctgccctttttgctgcagtcttgacatcttaacgtggatagaaaaaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctct

SEQ ID NO: 186132 - DNA, 307 bp, Homo sapiens
  Payload ID: 16652
  Gene Symbol: SPON2
  Gene Name: spondin 2, extracellular matrix protein
  ENST ID: ENST00000514490
  CDS Start-End: 236-307
agcatgtagactgaagtcaggccacgcacagggctctccaggtcacaccctgcgcaagaaggtgtagcacgctggctctaatttcgagaaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgcc

SEQ ID NO: 186133 - DNA, 557 bp, Homo sapiens
  Payload ID: 16652
  Gene Symbol: SPON2
  Gene Name: spondin 2, extracellular matrix protein
  ENST ID: ENST00000511672
  CDS Start-End: 535-557
aagagccccgggaagagctgcatgcacacggctggagagaggctctgcacccgagcacagcctgctgcgactcctcatagacccggaaaactgattagaaggcagagggcctcctccctccctgcgtggtttgggggctgttcctgatagcacagatgccctgatcacaaacacctgcctgcattgctgaccacaggcctggcctggagaaacccacagcctcttcagggaagcgagcaaggggcttggaagtgcctgaagccagtgggctggggactcacggccgggacactcagggcagtttcctcactgcttggaggaagatgagaattctcagaggtccttatgctgccctttttgctgcagtcttgacatcttaacgtggatagaaaaaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgc

SEQ ID NO: 186134 - DNA, 571 bp, Homo sapiens
  Payload ID: 16652
  Gene Symbol: SPON2
  Gene Name: spondin 2, extracellular matrix protein
  ENST ID: ENST00000502483
  CDS Start-End: 389-571
gagccctgagccgccggctgcggggttggagccgccggctgcggggttggagccgccggctgcggggttggagacgccggctgcggggttggagccgccggctgcggggttggagccgccggctgcggggttggaaccgccggctgtgagtttcctcactgcttggaggaagatgagaattctcagaggtccttatgctgccctttttgctgcagtcttgacatcttaacgtggatagaaaaaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtacccc

SEQ ID NO: 186135 - DNA, 556 bp, Homo sapiens
  Payload ID: 16652
  Gene Symbol: SPON2
  Gene Name: spondin 2, extracellular matrix protein
  ENST ID: ENST00000511679
  CDS Start-End: 510-556
gtgtgtttgtgaactggcgatgtgatcgagggcacgggtgctgggcttccccctcatgggtaaaaccagagctactgtatgccagccgtggaggcatggacggcccctgagctcggacagcagacggacagaccgttgacgcgttggcaccgtggccagagtccgttcaagaaaggtcggcagagagggctgagaacgcggcaggcacatcctccaagggccctgctggaacccctggagcaggaggaagcggtgattctccaggccttggtttcctcactgcttggaggaagatgagaattctcagaggtccttatgctgccctttttgctgcagtcttgacatcttaacgtggatagaaaaaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgc

SEQ ID NO: 186136 - DNA, 597 bp, Homo sapiens
  Payload ID: 16652
  Gene Symbol: SPON2
  Gene Name: spondin 2, extracellular matrix protein
  ENST ID: ENST00000503765
  CDS Start-End: 272-597
gatgcctgcgccgggagccaggagcttccccagccacttccagcatgtagactgaagtcaggccacgcacagggctctccaggtcacaccctgcgcaagaaggtgtagcacgctggctctaatttcgagaaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaagga

SEQ ID NO: 186137 - DNA, 571 bp, Homo sapiens
  Payload ID: 16652
  Gene Symbol: SPON2
  Gene Name: spondin 2, extracellular matrix protein
  ENST ID: ENST00000515004
  CDS Start-End: 379-571
ctgagccgccggctgcggggttggagccgccggctgcggggttggagccgccggctgcggggttggagacgccggctgcggggttggagccgccggctgcggggttggagccgccggctgcggggttggaaccgccggctgtgagtttcctcactgcttggaggaagatgagaattctcagaggtccttatgctgccctttttgctgcagtcttgacatcttaacgtggatagaaaaaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtaccccctgttccgcc

SEQ ID NO: 186138 - DNA, 2156 bp, Homo sapiens
  Payload ID: 16652
  Gene Symbol: SPON2
  Gene Name: spondin 2, extracellular matrix protein
  Uniprot ID: Q9BUD6
  ENST ID: ENST00000617421
  CDS Start-End: 626-1621
ggttctgacactgagggctccggggcaggggcagggcccgctggcttggcgtgcgcgtgcgtgcacaggtgtgtgggtgtctgcctggtgggcgggcggcgtgtgcgtgtgcgcatgtgtgtttgtgaactggcgatgtgatcgagggcacgggtgctgggcttccccctcatgggtaaaaccagagctactgtatgccagccgtggaggcatggacggcccctgagctcggacagcagacggacagaccgttgacgcgttggcaccgtggccagagtccgttcaagaaaggtcggcagagagggctgagaacgcggcaggcacatcctccaagggccctgctggaacccctggagcaggaggaagcggtgattctccaggccttggtttcctcactgcttggaggaagatgagaattctcagaggtccttatgctgccctttttgctgcagtcttgacatcttaacgtggatagaaaaaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccctggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgcggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctc

SEQ ID NO: 186139 - DNA, 2348 bp, Homo sapiens
  Payload ID: 16653
  Gene Symbol: SPRY1
  Gene Name: sprouty RTK signaling antagonist 1
  Uniprot ID: O43609
  ENST ID: ENST00000339241
  CDS Start-End: 188-1147
ggagtgagaccgctctgcaaaccactgcgtgctttgcagagtgattatcagcacagttccctgccctggataaggaacagctacagtcgctgttaaatgtgcctgaaaagcaatttgcaatctttgcattaggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcctactgctattttgtccttagaccagatcaaggccataagaggcagcaatgaatacacagaagggccttcggtggtgaaaagacctgctcctcggacagcaccaagacaagaaaagcatgaaaggactcatgaaatcataccaattaatgtgaataataactacgagcacagacacacaagccacctgggacatgcagtactcccaagtaatgccaggggccccattttgagcagatcaaccagcactggaagtgcagccagctctgggagcaacagcagtgcctcttctgaacagggactgttaggaaggtcaccaccaaccagaccagtccctggtcataggtctgaaagggcaatccggacccagcccaagcaactgattgtggatgacttgaagggttccttgaaagaggacctgacacagcacaagttcatttgtgaacagtgtgggaagtgcaagtgtggagaatgcactgctcccaggaccctaccatcctgtttggcctgtaaccggcagtgcctttgctctgctgagagcatggtggaatatggaacctgcatgtgcttagtcaagggcatcttctaccactgctccaatgacgacgaaggggattcctattcagataatccttgctcctgttcacaatcacactgctgctctagatacctgtgtatgggagccatgtctttatttttaccttgcttactctgttatcctcctgctaaaggatgcctgaagctgtgcaggaggtgttatgactggatccatcgcccagggtgcagatgtaagaactccaacactgtctattgtaagctggagagctgcccctcccggggtcagggtaaaccatcatgatttttggaggtgggttgtacctcctgaacttttagctttcaagttgtggctgttttttgtttttgtttttgtttttgttttctttagaatttttccctgtttcccaccttctcttcccctgttgccaaggtctaactcatggatttttctctttcctcatggatgatcttcagcaagagtggactgggaagctgcacctggctcccactttcaacaagagcctctgccatccacttgagggtattgagagccagtgggcttttgtgtagcctttttgttctgcaagcaactttctaaagttgtgtacatgaacatacacccacatccagactacagtgatttagagttgttttgattgggtaccgtgggagcagggaaattggttttttaaaaagcaactgtttaattgcttaaataagctatgtattaaatctgtctccagttagggctatcttcctagcataggccccttaagtagcatgggggatatattttttgctataacgtaaaaattttcctttaaccactgccctctccttctttctccttcaaggttctttccccctcagttttgttgttgtcttactctggagatgccaagtgtattttttctttctatgtaattttagattcgccttacaatgtaaatcttcacattggagataatattggttggaccttgcccatcttcactctagccttcgtatttgtgaaggactcagccaccttccttcttcaccccatgcttctcaccaaatttttgttgtcattgagggcacttggataactcaagttgatatttatagctgatcaatctatatgtgtcacagaactatgctgcctaaagtgatcttggctccttaatggtccttttggccccttggatagttaacagctgagtaattctaatctcttctgtgttttccttgccttaaccacaaattgtggtgctttttgtatattttatgtataaatcacaaagttgaattctgactatttttaagacaaaagtctgttaaacttttttattgtaaagaatatttattatgcgaatctctattattttatggtatttattgcaaaagactgttgaaatgtactcatgtttgaatataacaaaatatcaatacttaacggaaaataaggtgacacgaagaaagtacatatgttaactataatgcagaaaatatattaattaatg

SEQ ID NO: 186140 - DNA, 2504 bp, Homo sapiens
  Payload ID: 16653
  Gene Symbol: SPRY1
  Gene Name: sprouty RTK signaling antagonist 1
  Uniprot ID: O43609
  ENST ID: ENST00000394339
  CDS Start-End: 341-1300
tatttattcagtgcggattgcagagggcgcagctccaccgtggtaacttgcaatgtggccgcccctgcgctggcttctttctcctcggccctcggtgaacccagcttttcctttaaagcatagacaaatccttgcttagggtcagccagaccgtgggcttgctttgggctcccgcgtggacgctgaaggctcttcatgatttctcagaaaccttggtgggccacccaaaaagtgtgttggaaatccacggtgatccttaatatggtgatgggattgtccgaaaaggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcctactgctattttgtccttagaccagatcaaggccataagaggcagcaatgaatacacagaagggccttcggtggtgaaaagacctgctcctcggacagcaccaagacaagaaaagcatgaaaggactcatgaaatcataccaattaatgtgaataataactacgagcacagacacacaagccacctgggacatgcagtactcccaagtaatgccaggggccccattttgagcagatcaaccagcactggaagtgcagccagctctgggagcaacagcagtgcctcttctgaacagggactgttaggaaggtcaccaccaaccagaccagtccctggtcataggtctgaaagggcaatccggacccagcccaagcaactgattgtggatgacttgaagggttccttgaaagaggacctgacacagcacaagttcatttgtgaacagtgtgggaagtgcaagtgtggagaatgcactgctcccaggaccctaccatcctgtttggcctgtaaccggcagtgcctttgctctgctgagagcatggtggaatatggaacctgcatgtgcttagtcaagggcatcttctaccactgctccaatgacgacgaaggggattcctattcagataatccttgctcctgttcacaatcacactgctgctctagatacctgtgtatgggagccatgtctttatttttaccttgcttactctgttatcctcctgctaaaggatgcctgaagctgtgcaggaggtgttatgactggatccatcgcccagggtgcagatgtaagaactccaacactgtctattgtaagctggagagctgcccctcccggggtcagggtaaaccatcatgatttttggaggtgggttgtacctcctgaacttttagctttcaagttgtggctgttttttgtttttgtttttgtttttgttttctttagaatttttccctgtttcccaccttctcttcccctgttgccaaggtctaactcatggatttttctctttcctcatggatgatcttcagcaagagtggactgggaagctgcacctggctcccactttcaacaagagcctctgccatccacttgagggtattgagagccagtgggcttttgtgtagcctttttgttctgcaagcaactttctaaagttgtgtacatgaacatacacccacatccagactacagtgatttagagttgttttgattgggtaccgtgggagcagggaaattggttttttaaaaagcaactgtttaattgcttaaataagctatgtattaaatctgtctccagttagggctatcttcctagcataggccccttaagtagcatgggggatatattttttgctataacgtaaaaattttcctttaaccactgccctctccttctttctccttcaaggttctttccccctcagttttgttgttgtcttactctggagatgccaagtgtattttttctttctatgtaattttagattcgccttacaatgtaaatcttcacattggagataatattggttggaccttgcccatcttcactctagccttcgtatttgtgaaggactcagccaccttccttcttcaccccatgcttctcaccaaatttttgttgtcattgagggcacttggataactcaagttgatatttatagctgatcaatctatatgtgtcacagaactatgctgcctaaagtgatcttggctccttaatggtccttttggccccttggatagttaacagctgagtaattctaatctcttctgtgttttccttgccttaaccacaaattgtggtgctttttgtatattttatgtataaatcacaaagttgaattctgactatttttaagacaaaagtctgttaaacttttttattgtaaagaatatttattatgcgaatctctattattttatggtatttattgcaaaagactgttgaaatgtactcatgtttgaatataacaaaatatcaatacttaacggaaaataaggtgacacgaagaaagtacatatgttaactataatgcagaaaatatattaattaatgaaa

SEQ ID NO: 186141 - DNA, 1012 bp, Homo sapiens
  Payload ID: 16653
  Gene Symbol: SPRY1
  Gene Name: sprouty RTK signaling antagonist 1
  ENST ID: ENST00000507703
  CDS Start-End: 385-1012
ttgtaaaaactggttcttggaaaggggctgcagaagacctcccgaggtggatgttactgagccgcccggcgagcaccagccgtgacaggtccgggcccggccgcgcggagccgcgggagaactgccctccgcagccggaagggggccgcggggagcgctcctggccggtggcggcgggggcgggggaggccgcgagccgaggcgctccaactccggcgatgccgcctcgccctccccgccgcggttgatgcggcacgtgcacgccgccgcccgcaccaggacctgggccgggtcgcacggcttggcccccggccaccgcttcggcctaggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcctactgctattttgtccttagaccagatcaaggccataagaggcagcaatgaatacacagaagggccttcggtggtgaaaagacctgctcctcggacagcaccaagacaagaaaagcatgaaaggactcatgaaatcataccaattaatgtgaataataactacgagcacagacacacaagccacctgggacatgcagtactcccaagtaatgccaggggccccattttgagcagatcaaccagcactggaagtgcagccagctctgggagcaacagcagtgcctcttctgaacagggactgttaggaaggtcaccaccaaccagaccagtccctggtcataggtctgaaagggcaatccggacccagcccaagcaactgattgtggatgacttgaagggttccttgaaagaggacctgacacagcacaagttcatttgtgaacagtgtgggaagtgcaagtgtggagaatgcactgctcccaggaccctaccatcctgtttggcctgtaaccggcagtgccttt

SEQ ID NO: 186142 - DNA, 641 bp, Homo sapiens
  Payload ID: 16653
  Gene Symbol: SPRY1
  Gene Name: sprouty RTK signaling antagonist 1
  ENST ID: ENST00000505319
  CDS Start-End: 440-641
gtagccggagtgagaccgctctgcaaaccactgcgtgctttgcagagtgattatcagcacagttccctgccctggataaggaacagctacagtcgctgttaaatgtgcctgaaaagcaatttgcaatctttgcattaggcatttcggccgtggaaccccaggctcggaggactgggtgtgagcgctgcccgggagaggctgacctgccgggaccggagtgcccggggacgctgtgcccccacttgcccaacgtgcggaatcggctaagcgcgtcggcctgcgcggggcacaagggacgacgcccgcctttctctctccgagaaggatccccaaacctcactctcttcactcctccccgctaaaaaaaaaaaaaaaaagaaaagggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcctactgctattttgtccttagaccagatcaaggccataagaggcagcaatgaatacacagaagggccttcggtggtgaaaagacctgctcctcggacag

SEQ ID NO: 186143 - DNA, 573 bp, Homo sapiens
  Payload ID: 16653
  Gene Symbol: SPRY1
  Gene Name: sprouty RTK signaling antagonist 1
  ENST ID: ENST00000508849
  CDS Start-End: 469-573
agtatgaagtttgttacaactatcattggaaatgcaaattgaagttgtgcctggtgttatgggttacactattcaaatcctctgcggttttgtgaatctggcttagtacttttagctaccttttgctttgaaagcactgagttaagaagttcttgaagaagaggaataattgtgcaggagtcaggattagatgttgaggactccgagactaaatccccgcaggttatgaatgtgttactcctcatgcgcaaagaaggtagaataaagtagaaactcgagagagctgagttgtgaaaacgagggggagctccaagaagttaacatgtaagacatagtttagagacattagtttaggaaatataggaaatggacttctttctgcgttgttccttaaaccatgttttttgcctcaggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcct

SEQ ID NO: 186144 - DNA, 2352 bp, Homo sapiens
  Payload ID: 16653
  Gene Symbol: SPRY1
  Gene Name: sprouty RTK signaling antagonist 1
  Uniprot ID: O43609
  ENST ID: ENST00000622283
  CDS Start-End: 184-1143
gcgctccaactccggcgatgccgcctcgccctccccgccgcggttgatgcggcacgtgcacgccgccgcccgcaccaggacctgggccgggtcgcacggcttggcccccggccaccgcttcggcctaggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcctactgctattttgtccttagaccagatcaaggccataagaggcagcaatgaatacacagaagggccttcggtggtgaaaagacctgctcctcggacagcaccaagacaagaaaagcatgaaaggactcatgaaatcataccaattaatgtgaataataactacgagcacagacacacaagccacctgggacatgcagtactcccaagtaatgccaggggccccattttgagcagatcaaccagcactggaagtgcagccagctctgggagcaacagcagtgcctcttctgaacagggactgttaggaaggtcaccaccaaccagaccagtccctggtcataggtctgaaagggcaatccggacccagcccaagcaactgattgtggatgacttgaagggttccttgaaagaggacctgacacagcacaagttcatttgtgaacagtgtgggaagtgcaagtgtggagaatgcactgctcccaggaccctaccatcctgtttggcctgtaaccggcagtgcctttgctctgctgagagcatggtggaatatggaacctgcatgtgcttagtcaagggcatcttctaccactgctccaatgacgacgaaggggattcctattcagataatccttgctcctgttcacaatcacactgctgctctagatacctgtgtatgggagccatgtctttatttttaccttgcttactctgttatcctcctgctaaaggatgcctgaagctgtgcaggaggtgttatgactggatccatcgcccagggtgcagatgtaagaactccaacactgtctattgtaagctggagagctgcccctcccggggtcagggtaaaccatcatgatttttggaggtgggttgtacctcctgaacttttagctttcaagttgtggctgttttttgtttttgtttttgtttttgttttctttagaatttttccctgtttcccaccttctcttcccctgttgccaaggtctaactcatggatttttctctttcctcatggatgatcttcagcaagagtggactgggaagctgcacctggctcccactttcaacaagagcctctgccatccacttgagggtattgagagccagtgggcttttgtgtagcctttttgttctgcaagcaactttctaaagttgtgtacatgaacatacacccacatccagactacagtgatttagagttgttttgattgggtaccgtgggagcagggaaattggttttttaaaaagcaactgtttaattgcttaaataagctatgtattaaatctgtctccagttagggctatcttcctagcataggccccttaagtagcatgggggatatattttttgctataacgtaaaaattttcctttaaccactgccctctccttctttctccttcaaggttctttccccctcagttttgttgttgtcttactctggagatgccaagtgtattttttctttctatgtaattttagattcgccttacaatgtaaatcttcacattggagataatattggttggaccttgcccatcttcactctagccttcgtatttgtgaaggactcagccaccttccttcttcaccccatgcttctcaccaaatttttgttgtcattgagggcacttggataactcaagttgatatttatagctgatcaatctatatgtgtcacagaactatgctgcctaaagtgatcttggctccttaatggtccttttggccccttggatagttaacagctgagtaattctaatctcttctgtgttttccttgccttaaccacaaattgtggtgctttttgtatattttatgtataaatcacaaagttgaattctgactatttttaagacaaaagtctgttaaacttttttattgtaaagaatatttattatgcgaatctctattattttatggtatttattgcaaaagactgttgaaatgtactcatgtttgaatataacaaaatatcaatacttaacggaaaataaggtgacacgaagaaagtacatatgttaactataatgcagaaaatatattaattaatgaaactgtc

SEQ ID NO: 186145 - DNA, 2608 bp, Homo sapiens
  Payload ID: 16653
  Gene Symbol: SPRY1
  Gene Name: sprouty RTK signaling antagonist 1
  Uniprot ID: O43609
  ENST ID: ENST00000610581
  CDS Start-End: 440-1399
gtagccggagtgagaccgctctgcaaaccactgcgtgctttgcagagtgattatcagcacagttccctgccctggataaggaacagctacagtcgctgttaaatgtgcctgaaaagcaatttgcaatctttgcattaggcatttcggccgtggaaccccaggctcggaggactgggtgtgagcgctgcccgggagaggctgacctgccgggaccggagtgcccggggacgctgtgcccccacttgcccaacgtgcggaatcggctaagcgcgtcggcctgcgcggggcacaagggacgacgcccgcctttctctctccgagaaggatccccaaacctcactctcttcactcctccccgctaaaaaaaaaaaaaaaaagaaaagggatttcagatgcatgccaggtttccactgattgccagaactcgagatcactacacatggatccccaaaatcaacatggcagtggcagttcgttagttgtgatccagcagccttctttggatagccgtcagagattagactatgagagagagattcagcctactgctattttgtccttagaccagatcaaggccataagaggcagcaatgaatacacagaagggccttcggtggtgaaaagacctgctcctcggacagcaccaagacaagaaaagcatgaaaggactcatgaaatcataccaattaatgtgaataataactacgagcacagacacacaagccacctgggacatgcagtactcccaagtaatgccaggggccccattttgagcagatcaaccagcactggaagtgcagccagctctgggagcaacagcagtgcctcttctgaacagggactgttaggaaggtcaccaccaaccagaccagtccctggtcataggtctgaaagggcaatccggacccagcccaagcaactgattgtggatgacttgaagggttccttgaaagaggacctgacacagcacaagttcatttgtgaacagtgtgggaagtgcaagtgtggagaatgcactgctcccaggaccctaccatcctgtttggcctgtaaccggcagtgcctttgctctgctgagagcatggtggaatatggaacctgcatgtgcttagtcaagggcatcttctaccactgctccaatgacgacgaaggggattcctattcagataatccttgctcctgttcacaatcacactgctgctctagatacctgtgtatgggagccatgtctttatttttaccttgcttactctgttatcctcctgctaaaggatgcctgaagctgtgcaggaggtgttatgactggatccatcgcccagggtgcagatgtaagaactccaacactgtctattgtaagctggagagctgcccctcccggggtcagggtaaaccatcatgatttttggaggtgggttgtacctcctgaacttttagctttcaagttgtggctgttttttgtttttgtttttgtttttgttttctttagaatttttccctgtttcccaccttctcttcccctgttgccaaggtctaactcatggatttttctctttcctcatggatgatcttcagcaagagtggactgggaagctgcacctggctcccactttcaacaagagcctctgccatccacttgagggtattgagagccagtgggcttttgtgtagcctttttgttctgcaagcaactttctaaagttgtgtacatgaacatacacccacatccagactacagtgatttagagttgttttgattgggtaccgtgggagcagggaaattggttttttaaaaagcaactgtttaattgcttaaataagctatgtattaaatctgtctccagttagggctatcttcctagcataggccccttaagtagcatgggggatatattttttgctataacgtaaaaattttcctttaaccactgccctctccttctttctccttcaaggttctttccccctcagttttgttgttgtcttactctggagatgccaagtgtattttttctttctatgtaattttagattcgccttacaatgtaaatcttcacattggagataatattggttggaccttgcccatcttcactctagccttcgtatttgtgaaggactcagccaccttccttcttcaccccatgcttctcaccaaatttttgttgtcattgagggcacttggataactcaagttgatatttatagctgatcaatctatatgtgtcacagaactatgctgcctaaagtgatcttggctccttaatggtccttttggccccttggatagttaacagctgagtaattctaatctcttctgtgttttccttgccttaaccacaaattgtggtgctttttgtatattttatgtataaatcacaaagttgaattctgactatttttaagacaaaagtctgttaaacttttttattgtaaagaatatttattatgcgaatctctattattttatggtatttattgcaaaagactgttgaaatgtactcatgtttgaatataacaaaatatcaatacttaacggaaaataaggtgacacgaagaaagtacatatgttaactataatgcagaaaatatattaattaatgaaactgtc

SEQ ID NO: 186146 - DNA, 2708 bp, Homo sapiens
  Payload ID: 16654
  Gene Symbol: SPRY2
  Gene Name: sprouty RTK signaling antagonist 2
  Uniprot ID: O43597
  ENST ID: ENST00000377102
  CDS Start-End: 979-1926
ggggggactgggaaagagaagaggggcggaggtagggagtccagctttgaagaaggaggccagggatcggatcggcagaaatcacttaaaaaataaaaacaaaaaagcccccttttatttcaaagatgctactttgactgcaagcaaatctgcaccgaaagtttacagctccgggagctgggtcctgcgcgcccggagtgagcagtgggaccctggaaaatgccctttttttaaaaagccatttttctttcactttaagaaatatgatatcttttttttttctctcgacccaaaaggagataggcgtgtgcagattacaggcaatgcccccttcggtcagtgcagcgtggagtcgccgtgtgtgcgtgggttggacttgtgcgtcctggctgcgtgtctcaggcagggctttcgtgctcgcagtgtcggggtgggaaacctgtgccggatgtccgaggggctttgcagaaagcctggcagtgggcggcgtgacctctgcctgggggcggagtggctccttggggctggaaggcagttctcttgagttgggggagatcttagctggggagagggaggcgggggaagtgtgctcctgcatttcgtgacacgtacccttcggaggcgcccgcggcccccgcctgtctgagtctggggatcgtaagcaggggggcagcctggcccatggacagcgtcagtccgcctggagaaactcccctggggatcggctgtgtcccacctgctggggacggtgttggggcacagagaggcgataaactaagtgaaagcaaagagcagcgttgtcttctgccattcttttggaggtgaggagatccggtttccagcactgccttgctccgaattgggagacgtttgtcacctgccttgttcgctgtggcctctattctaaagagcggagatcggataaaggagttcagatgtgttctaagcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatccgaaacaccaatgagtacacagaggggcctactgtcgtcccaagacctgggctcaagcctgctcctcgcccctccactcagcacaaacacgagagactccacggtctgcctgagcaccgccagcctcctaggctccagcactcgcaggtccattcttctgcacgagcccctctgtccagatccataagcacggtcagctcagggtcgcggagcagtacgaggacaagtaccagcagcagctcctctgaacagagactgctaggatcatccttctcctccgggcctgttgctgatggcataatccgggtgcaacccaaatctgagctcaagccaggtgagcttaagccactgagcaaggaagatttgggcctgcacgcctacaggtgtgaggactgtggcaagtgcaaatgtaaggagtgcacctacccaaggcctctgccatcagactggatctgcgacaagcagtgcctttgctcggcccagaacgtgattgactatgggacttgtgtatgctgtgtgaaaggtctcttctatcactgttctaatgatgatgaggacaactgtgctgacaacccatgttcttgcagccagtctcactgttgtacacgatggtcagccatgggtgtcatgtccctctttttgccttgtttatggtgttaccttccagccaagggttgccttaaattgtgccaggggtgttatgaccgggttaacaggcctggttgccgctgtaaaaactcaaacacagtttgctgcaaagttcccactgtcccccctaggaactttgaaaaaccaacatagcatcattaatcaggaatattacagtaatgaggattttttctttctttttttaatacacatatgcaaccaactaaacagttataatcttggcactgttaatagaaaggtgggatagtctttgctgtttgcggtgaaatgctttttgtccatgtgccgttttaactgatatgcttgttagaactcagctaatggagctcaaagtatgagatacagaacttggtgacccatgtattgcataagctaaagcaacacagacactcctaggcaaagtttttgtttgtgaatagtacttgcaaaacttgtaaattagcagatgacttttttccattgttttctccagagagaatgtgctatatttttgtatatacaataatatttgcaactgtgaaaaacaagttgtgccatactacatggcacagacacaaaatattatactaatatgttgtacattcggaagaatgtgaatcaatcagtatgtttttagattgtattttgccttacagaaagcctttattgtaagactctgatttccctttggacttcatgtatattgtacagttacagtaaaattcaacctttattttctaattttttcaacatattgtttagtgtaaagaatatttatttgaagttttattattttataaaaaagaatatttattttaagaggcatcttacaaattttgccccttttatgaggatgtgatagttgctgcaaatgaggggttacagatgcatatgtccaatataaaatagaaaatatattaacgtttgaaattaaa

SEQ ID NO: 186147 - DNA, 2111 bp, Homo sapiens
  Payload ID: 16654
  Gene Symbol: SPRY2
  Gene Name: sprouty RTK signaling antagonist 2
  Uniprot ID: O43597
  ENST ID: ENST00000377104
  CDS Start-End: 382-1329
gtaaggccgttttcttttcccattcgctcatctgccaggaaaagggacttgccgttggcgcttcggcctcttgttcattgagaaaaaagaggaaatactccgcgtgcgcttgtagaaggggagtcgtctccagctccgaaccccggagtgttcatcagcggggaatctggctccgaattctctttttttctcccgccgattgctcggaagttggtctaaagcagaggttggaaagaaaggaaaaaagtttgcatcgagactggatttatttgcacatcgcagaaagaagagaatccaagggagaggggttggtgcaaagccgcgatcacggagttcagatgtgttctaagcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatccgaaacaccaatgagtacacagaggggcctactgtcgtcccaagacctgggctcaagcctgctcctcgcccctccactcagcacaaacacgagagactccacggtctgcctgagcaccgccagcctcctaggctccagcactcgcaggtccattcttctgcacgagcccctctgtccagatccataagcacggtcagctcagggtcgcggagcagtacgaggacaagtaccagcagcagctcctctgaacagagactgctaggatcatccttctcctccgggcctgttgctgatggcataatccgggtgcaacccaaatctgagctcaagccaggtgagcttaagccactgagcaaggaagatttgggcctgcacgcctacaggtgtgaggactgtggcaagtgcaaatgtaaggagtgcacctacccaaggcctctgccatcagactggatctgcgacaagcagtgcctttgctcggcccagaacgtgattgactatgggacttgtgtatgctgtgtgaaaggtctcttctatcactgttctaatgatgatgaggacaactgtgctgacaacccatgttcttgcagccagtctcactgttgtacacgatggtcagccatgggtgtcatgtccctctttttgccttgtttatggtgttaccttccagccaagggttgccttaaattgtgccaggggtgttatgaccgggttaacaggcctggttgccgctgtaaaaactcaaacacagtttgctgcaaagttcccactgtcccccctaggaactttgaaaaaccaacatagcatcattaatcaggaatattacagtaatgaggattttttctttctttttttaatacacatatgcaaccaactaaacagttataatcttggcactgttaatagaaaggtgggatagtctttgctgtttgcggtgaaatgctttttgtccatgtgccgttttaactgatatgcttgttagaactcagctaatggagctcaaagtatgagatacagaacttggtgacccatgtattgcataagctaaagcaacacagacactcctaggcaaagtttttgtttgtgaatagtacttgcaaaacttgtaaattagcagatgacttttttccattgttttctccagagagaatgtgctatatttttgtatatacaataatatttgcaactgtgaaaaacaagttgtgccatactacatggcacagacacaaaatattatactaatatgttgtacattcggaagaatgtgaatcaatcagtatgtttttagattgtattttgccttacagaaagcctttattgtaagactctgatttccctttggacttcatgtatattgtacagttacagtaaaattcaacctttattttctaattttttcaacatattgtttagtgtaaagaatatttatttgaagttttattattttataaaaaagaatatttattttaagaggcatcttacaaattttgccccttttatgaggatgtgatagttgctgcaaatgaggggttacagatgcatatgtccaatataaaatagaaaatatattaacgtttgaaattaaa

SEQ ID NO: 186148 - DNA, 1689 bp, Homo sapiens
  Payload ID: 16654
  Gene Symbol: SPRY2
  Gene Name: sprouty RTK signaling antagonist 2
  ENST ID: ENST00000540649
  CDS Start-End: 157-1218
tgaggagatccggtttccagcactgccttgctccgaattgggagacgtttgtcacctgccttgttcgctgtggcctctattctaaagagcggagatcggataaaggagttcagatgtgttctaagcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatccgaaacaccaatgagtacacagaggggcctactgtcgtcccaagacctgggctcaagcctgctcctcgcccctccactcagcacaaacacgagagactccacggtctgcctgagcaccgccagcctcctaggctccagcactcgcaggtccattcttctgcacgagcccctctgtccagatccataagcacggtcagctcagggtcgcggagcagtacgaggacaagtaccagcagcagctcctctgaacagagactgctaggatcatccttctcctccgggcctgttgctgatggcataatccgggtgcaacccaaatctgagctcaagccaggtgagcttaagccactgagcaaggaagatttgggcctgcacgcctacaggtgtgaggactgtggcaagtgcaaatgtaaggagtgcacctacccaaggcctctgccatcagactggatctgcgacaagcagtgcctttgctcggcccagaacgtgattgactatgggacttgtgtatgctgtgtgaaaggtctcttctatcactgttctaatgatgatgaggacaactgtgctgacaacccatgttcttgcagccagtctcactgttgtacacgatggtcagccatgggtgtcatgtccctctttttgccttgtttatggtgttaccttccagccaagggttgccttaaattgtgccaggggtgttatgaccgggttaacaggcctggttgccgctgtaaaaactcaaacacagtttgctgcaaagttcccactgtcccccctaggactttgaaaaaccaacatagcatcattaatcaggaatattacagtaatgaggattttttctttctttttttaatacacatatgcaaccaactaaacagttataatcttggcactgttaatagaaaggtgggatagtctttgctgtttgcggtgaaatgctttttgtccatgtgccgttttaactgatatgcttgttagaactcagctaatggagctcaaagtatgagatacagaacttggtgacccatgtattgcataagctaaagcaacacagacactcctaggcaaagtttttgtttgtgaatagtacttgcaaaacttgtaaattagcagatgacttttttccattgttttctccagagagaatgtgctatatttttgtatatacaataatatttgcaactgtgaaaaacaagttgtgccatactacatggcacagacacaaaatattatactaatatgttgtacattcggaagaatgtgaatcaatcagtatgtttttagattgtattttgccttacagaaagcctttattgtaagactctgatttccctttggacttcatgtatattgtacagttacagtaaaattcaacctttattttct

SEQ ID NO: 186149 - DNA, 9019 bp, Homo sapiens
  Payload ID: 16655
  Gene Symbol: SPRY3
  Gene Name: sprouty RTK signaling antagonist 3
  Uniprot ID: O43610
  ENST ID: ENST00000302805
  CDS Start-End: 432-1298
tttgggaaatacgtccatcaagatttagatctgcctgtaaaatctatacaaagtatatgccactacaggtttgactcgccccctcccccgtttttttgttttgttttgttttgttttgttttgttttgtgttttctctgctgtgtcaaagaacaagacagaactatctctgtttctggctccactgcctgccagtgaaggagttttcattcagactttccgaagagaggtggagaaacctaaagactgaggagaagagatcctttgagccagatggggcattagttcttctgcttttctcagcatggataaaccatttcctcaaggattttctcatgtgccctgaaatccatgtaactacaagggctcctctttatcaccataagtgccaccctgacttaaaaccactcagagctaaaaaatcaaggcaaaatggatgctgcggtgacagatgattttcaacaaattctgcctattgaacagctgcgctctactcatgctagcaatgactacgtggaacggcctccagccccctgtaaacaggccctctccagcccttcccttattgtgcaaacccacaagtctgattggtctctggctaccatgcctacttctctcccccgcagtctcagccagtgccatcaactgcagcccttgcctcagcatctgagccaatctagcattgccagctcaatgtcccatagcaccactgcctctgatcaaaggctcttggccagcattacaccctcaccttcaggccaatccatcatccgaacccaacctggagcaggggtccacccaaaggctgatggtgctctgaagggagaagctgagcaatctgcagggcaccctagtgagcacctcttcatctgtgaggaatgtgggcgctgcaagtgcgtcccctgcacagcagctcgccctctcccctcctgctggctgtgcaaccagcgctgcctttgctctgctgagagcctcctcgattatggcacttgtctctgctgtgtcaagggcctcttctaccactgctccactgatgatgaagacaactgtgctgatgagccctgctcttgtgggcctagttcttgctttgtccgctgggcagccatgagcctcatctccctcttcctaccctgcctgtgctgctacctgcctacccgtggatgcctccatctgtgccaacagggctatgatagcctccggcgaccaggctgccgctgcaagaggcacaccaacactgtgtgcagaaagatctcttctggtagtgcacccttccccaaggcccaggaaaagtctgtatgaccttccaacaaggtggatccagagcttttctccttcgagtccccaacagcaaagcataggcctcatctttggagagggggaggagtgataaactagccaaagttagggcctctcttttgttcctgcagtgtcaggggaatgaccaagtacatcctggtgcaggatgccttgttctttctcacagtatctatcccactcctcttcagtctttacaccctgccagctcagcctttatggttgtcatggcaaattcaggtgatatatgggtatgaggtttgaacactgaggactgacagggccagcaacgtggaggtttaggggctccccaatgtaatacctctcgatgcaggctctgatcgtcactctgttttctgctgtgcctttggaagctttcttctaagatggttttcacaggtacatgtggaacagcgttcaaccttccagggaatacgaccccttctccctgttactgcccttctcttctttattcctctctcctctttcattattctgttctgtattcctttccccttcattctcaccctgtctgcttttactttttctctttcttcctccctttctccttctcccctccttctttttcagactgatcctttctctgcctgtatttctatctcatttgatctatatttgtctctctctacctgtccctttttctctaacatgtccaaaagtgctgtttttccatagatgtttccttagatgccaaactttgctatgctatactatttactaatttttattaagggaaatggattactgtaatgaactgatcactagcaatagtgtgtatcccgatgtgtgtgtgtgctcacaaccactctcacctgttcgtgagcgcatgaggcgaagttatcttatatttccaggtttaactagttggagtttttctccctttctcaataatcaacttatagtgctgacagattccactagcatgctgagtaggatagtaaatcaggatgctcataactttgtatgtctgacccaagtgccaaaggcagacgtgctttatagctaaatgaacaaagcaaaggatacagaggtatgttctctcttagaagctaacttccctgagactgcatggctcaggcgttaataatggacataaaaagtcataaaacgttagagctggaaggaatcttaactattaatctagttcaatgcccttattttacagatgggaaaactgaggcctggaggtaggaagggacttgcccccaaggccgcacactgagttaacagcagaattgagactggaatataggccttctgactcctagttcagtattcttacccctgtaccacattgagtcatgggactttttcctagggctctattaacagtgacagaaagccattcccattcaattacttttcaggaaccatgcctagttagtgtggtggtctttctccagtgcatggtgggtagctaattaactatcaggtgttgaggctgcccccagtggacatcacctttggctctgtcaccttgtagaagctcaagtgtggaaaagaaaagcttaaagaagccctaaccaagctgtatcttcgccattgcatctactctttgctgcacacactgtgcttgctcctggctttgtctgcaatggcagctgcctgagaacttaaatttcagcaacagtgaaaaactgagatgaaagatgtataatgtagagaactgacttctctcttaaaaagtacagagagcctgtgctgtgaacccccttcaatgggaaaaagctgcagtggtgatggcaggctcctaaagactgctgctaaaagacacaagaattatacagtttccctctataagtgaatccaaaattcactgacgaattcagagattgagggcacttgcttgaaatcaaggtgctccaacttagtttaagacctccagactctaactttatagatcatctcttctagagtgtgcatggatgtgtgttgcagggtggagaagtggggagaagtgtatagtagtacacggggggaagaggggacctccatgtccctttgttggatacatattacagaaatatgtgccactcactttttgttggttctgaatcttcctgaagtgtactgacatttgggctgcacagagccccacaccttcacttacacctcctcttctagaattgctttgctctatttttgtatatataaatatgttatgatgattattaataatgttaatgatattgctgcaaatggtgccatatataaggttaggcttcttggaacatttataaacccaaaccaatacctgtaacctcttatgttgctttcagatccttcaattttaagtaactttttaatcttacaagtctgcttgattgtactttacacttatctaccctgaaaagctctgcccagttctctgggtcaagctggatggtgatgagtagcaacacacacttctctgcttctgcctgaaatgtgcttagagctcagttatctaaggattctctgacactagtgcattgttcctggagctaaattattctatggatgtttgcttattagtttcaggccccaaaataacacgagcccctcctccttgatagctccttgatatcccaatcttgcagtcctaactcaggcaaattgtgcactgccagaggggccctgggttctgccatatacccagaggagcctttctcagtgtgtttctaaatggccttacacttggtagaagaaattgaagggttactcaaatacagttgcaatctgcaatctgctgttgagtcagggctttcacttgtgtccaagttggcctgatatggactgcatctgctttacgtatagatgggtcctgttgggatatgcgcatggacgtgtgagtgagtgtgcgtatgtatcccttctgtgattatatatattcacacatctctatatattttaatgtattgcacatgtatatttaaaatatatacgaaagaactctaaatcctgcagggaggctctgttttcattatttttctactttgtgtcatgtcctgtataaacaggaatatttagagggtgtttcctgcttagcatttttttgcagttaaatcatctgttagcccctaactctactgccttccacatattggttccttgatacatttcatatgatatcagccaagagttttcctgtggttccagcccatcttccctaatcacaatagcaataataaatatagtgaatacttacatagtgcttactatatgctaagcactatttttagcatgttatttatattagctcattcattcctcacaattctacaacataggtatcattccaacctctattttacagatgagaaaactgaagcacagagaagttaagtgacttgccaaaaggtaacaattgtaaatggtagagctaagatttgaacccagggtgtctgactcccaggtccatgctccagagtcagatatagaaggctggagcacagtgtaaaccattctggagtaacaagcctcaaatggtgaataattctttccctaactctggtccacctgcaacctaggagttaaaataagtatcttgctatgttaagagtaaagcaatagttacaggcatcatatattagctgtcttgctcccaaaatggtgacattacaaacttttccactattccctttgaaaacatgcttgcagccagttaccatttcttagcttatgatgtagagctattaagggagtattttcacttgtgccaaagagggtaagcgtttattagccttatctttattggccagggaaaactaattcaatttttttttgaacaaagtataactgagactatttttggagcttaagatttgttagagctgttaacattcaaccttattgattatattgagagcgctcttctgattcaaatgtaagcaaaccactgatgaccactggtccgtataacacattttaccaacagctccttcacactgaatcctttaacttggccaaaggacccttaaagaacatctagtccaatgtcaacattttatagctggagaaagggatgcacagagagggaaaataacctgtccaaagtcacacagttctgaaaattgagtggaattatgactttataccagagttcctaatttccaggtatcttagcctcagtttcttaaaaaatagagtttgaagcaaaagctatgtacgatccagggtagtatgagtaaggaaagggttaatgagggagggaagaaagaagaacaaataaaaagcatgtcactgagttggccacagtctgttccttggcaagctaatttcgcaattttttgtgacagaccatataaaactactacatctccatacagcccacgtggtggaggaaaggaggtgaattcatctgctagctctcatctcattagtcaaattcttccccatgtgatatttacccttctacatttttgggtagtgcgtgatgggcacttaaatatgtaccttggcatttcatgcttcagcaataatgggaaggattgtggctccactataaacagtaaggcaagtatatgaatatagggagattaaatttaaagtgctacactagggtggtgcttttaccttatgtctttaatcacattccttcgaagtaagttagagataacctaccacctttaaagtaaataaagctttattgtggctcttagaactgtactatgtttgccttcctgaacctatttattctctagcttgctttaaagggcttcttttttatatggaaattaattccctgttcaattaaaggagtaacaaactctcaaaatatctttcttcttaatataaaaaggaatttcatattattgaactcctcaaaaagcatgtgtaagtcaaaatatgtatgtgaaggcacatatgttcttttaggttccatgagcataatagcaggaaaactggttaagtcaataaatgctggggaaaaaatggctaaacaaggtattctgtaacatgaaaataaagcaatgagttggttggctggctttttaaaaaatatttcagccactaattatgacacagacacattataagaattatgctaccttttattcacatatacaatagttccctgtgtcctatagatcattgtcacataaagcaaaagcattagtgccccatttggacctttggccgaaggtttgataagattttgtaggactgaaattcttggtccctttatcctagtttaggcccatatccttattttcactctcaaagataagatcatgacactaccagtgttgctgctgttaaaggccaggatggacaagataaggaaaggcattttgggaatgacactgactaatgttaggaatcttgctgtcattacaatccaagttatatatgtttgctcccatatgtatttgttggccaatctcctgaaaaagaagaaggtaattctaacccacacattgtcattcccaaactaacctggcaatccttttgaccataccaggtaatagtcatccctctgatggtaaaagacagagatgtcaaggctctggaagctcccaggtccttgaagaactaactaaactgctgaacacagaagtggtaatgtaggcaagccacaggtatgttctcttgtaacaagatggggttgaccatatgtgaaccctgaagagtcattttgaacctgtgtcctaaggcctagagtactttaatcctcatcttcaaagtcttaccactctgataacaaaaagaaacactacaaagaaactgcaaggaaagggacagtcattttttttaatatctaccaattatttagttattcatatatgcatttctttatatagaaaagtatttatatgaagtttccaaaagactctgatattcagctttatagtcttggatagaaaatcatgtgtccttggatggggattcacacaccaaggcttaacagaattagtttggggaatactcatttttactctagagattagttggcttaaacaactttactcgtgaatttttttcttaatggaggtgaagacctcccaaagaggagaaggccccaggcctttcttaatatataaaccatattgaaagaaagaaagaaaaaagtaatgggaagtaatagtaaatgtggatccagaaagaaaaacaaaggttaagaaaatgatgtatgtgaaagaaaaaaagctctataatcagtgtgtttctctcacctaaaacaccatttactaactacttggttcagttgtaccctttaactctattttgtccttgacttatatcaacactcttcttttccaaactcctatagctctccatctggaatgattctatggggtggggggtcgggggaggagaaagggagacagcagaagaaagaaagagagagaaagatagagagagagagagagatgggtggagacttggcctctctcctagaggttcaaagttagaatatgccactaacactatctgcctttcaaactcccttctaggacatgctccatagtacttagatcttatatcaaatgacaaggtttctctccttcagagagaaataccagactggatttgtggtttccctggattggttttttctgagtcaaagtggtgttgtagaaatcacagtaccctgagaccaattaagtcagaatctttggaggtgttgaggaatggatttttaaagttcccagatgattataatatgcaaacagatttgagaaaattgaatcactttattccataaatgcagatagtgaggctaagagagggaaagtgacttactcataaccacaccgtgagttagtgaccaagtcaggataagaatccaggtctgctgactcctaggccagaattcttgtctttatactacactgcttctatctctaccctattccccctctgagcctttgcttttctcatctgtaaaatgacgataataaagcctagagagtgtatgagaatcattaaagcagaagcatttttcttaatgtacaaggttctatacaaatgcaagggaattaatgtataacatatatgtggggctaagtctctaaaacaacataataaaagttgtttttattttagtcaatcttttaggtattgtgtctacctgatagcatgtaacaagattgaacacttgtgtaggtcgtatgtgcctttaatctgaggttggcctcagtgacaatcaaaattagcagttgaggaaaaaggtcatacatttttctcttgcccttgctggaatagggatcaagaggaatataaaagcagtgggatatctggatttcttatactcagtcaaccacaacatggccttagtactgaactagcccagggtttcaatggaactcgtagatctcattcccaaggctggtcctggttgaagggagaaggtcaaaaaaggacgtgtcttctgaaaggcattacccatggaaagccaagggggagggttgcccactaggaggagcttcttttgtagaagccagaatggaggaaaggggctttctgacttggagcatctgaggaaatagattatttgaggatctagtactcccagaataatctgtaaccacaagaaacacatttcttgaactccagcgccccagaacaggatatccatatccaatcccatcgtatccatcctggatgttatgaatttccagagagggccacttctacccccctaggagtcatacatctggctacttatttgttaaaaataaaattctgtaccatttataaaa

SEQ ID NO: 186150 - DNA, 4938 bp, Homo sapiens
  Payload ID: 16656
  Gene Symbol: SPRY4
  Gene Name: sprouty RTK signaling antagonist 4
  ENST ID: ENST00000344120
  CDS Start-End: 188-1156
gcgagctgagctgacagcgcggagctggcgctgtggagcgcagggagccttgccggttcctccgaccggcgtctgcgagtacagcggcggctaacctgccccggcttcaggatttacacagacgtggggcgatgcttgtgaccctgcagctcctcaaaccagcctgtattgagcggtttgcagcctgatgctcagccccctccccacagggcccctagaagcctgtttctccgtacagtccaggacctccagccccatggagcccccgatcccacagagcgcccccttgactcccaactcagtcatggtccagccccttcttgacagccggatgtcccacagccggctccagcacccactcaccatcctacccattgaccaggtgaagaccagccatgtggagaatgactacatagacaaccctagcctggccctgaccaccggcccaaagcggacccggggcggggccccagagctggccccgacgcccgcccgctgtgaccaggatgtcacccaccattggatctccttcagcgggcgccccagctctgtgagcagcagcagcagcacatcctctgaccaacggctcttagaccacatggcaccaccacccgtggctgaccaggcctcaccaagggctgtgcgcatccagcccaaggtggtccactgccagccgctggacctcaagggcccggcggtcccacccgagctggacaagcacttcttgctgtgcgaggcctgtgggaagtgtaaatgcaaggagtgtgcatccccccggacgttgccttcctgctgggtctgcaaccaggagtgcctgtgctcagcccagactctggtcaactatggcacgtgcatgtgtttggtgcagggcatcttctaccactgcacgaatgaggacgatgagggctcctgcgctgaccacccctgctcctgctcccgctccaactgctgcgcccgctggtccttcatgggtgctctctccgtggtgctgccctgcctgctctgctacctgcctgccaccggctgcgtgaagctggcccagcgtggctacgaccgtctgcgccgccctggttgccgctgcaagcacacgaacagcgtcatctgcaaagcagccagcggggatgccaagaccagcaggcccgacaagcctttctgacagtttgtgtcgaagccccagtgctctgcctggaaacctggttctcttctgacatctaagaagactgcagcaaggtcagaggttttagcctcctgaggctgaccttgctagtctgcccactccctacccccagcttcggaaaatacagagaccaccaccacgtaccctgtattccccaaggtgatgaagaagcactttggggctttttttcagggtcctgaaactttgtgtcaaacagacaatgcaggggcagggtgtggtttggggggaaatttttctttttcagaagacagaacacagatgtggacacatatccggaaactgcagctgcttgaatgccttcccagcccctccttctccctccctccctccgcccccccccccttcctcttttccattgtctttggctctcacaggagctagctgcctgggaggaattgttaactgagtaccagggtacctttaaagaagacccttggagtcttctataccttcttctccttccccatctcactccaccccactttgtccctgatgtcttggggaaggtgtagaacaccctagcagttcctattgtatatacttgggagccactgagaacagaggacggccagtgagtccaagcctcgttcctccttctgcctccccggagccacaggatggatttaggagccactgctcagtgcacttctcccttccaactgcatcaactaactctcgggggtgttctgctcaccacaccgtccttcggttcttactgagtcacagactcgcctgcccactacgtgtcctgggttctctctactcagatcccttccagaaactttatatgggtagaggaagccagggcggcaaatgcgagaccaaatatcattttgccaatgagtctgaggctgtggtctctggatccagtcattatgtttttatagaataattaaaccggatgctaacggtgttttaaaaaataataataaaacaacttgtttccttttggccacccccaggaagggctgatttcaaaatctgggggcgagcaacctcaaggaacacaatttccctccctatcaacaagaggattttaacagcaaagaagagaggcagcacctcccattggcagaatgaccgctgagccaggctgggtttgggtttcttctcttctgattctgctgctcactgtcatagccttttgtgtatagtgatgtgtctgtatctttaatgtaaatagagagatgatgaaaaaagagtctattttagtgttaggaagccccagcaggggagtcggaagagcttggaagagctggggagagggtaggggaaaggtttttccaggggccactgggtttgagccctgcttctgtgcacagccacaccaccctctcccgacagccctcaaagacgtagcaactctttctctcaaggtgctaaaggactcagaaggtgcagcacgtccagtgggtaggtacttgttgcatgcaaaagctgtagtgtatctggtccttcctccccagcttttgtgtggggttcttgctttgtgtggtattttgttttcccctctaatgagagggcatggcctgagtcagaagagctaccccaggtgaaactggaagtgcatgaggcagagcgtccgtagcatttccagtttgttctgtataggaacagaggtgcctccgggaaggaggcagcgaggtaggtagctatgataggcacctaatgcttctcaaggacttattttttccttcttgaagactagtagtaacatcttatgatttagagtaagttgattgtaaccataggtatttattgattggaggaagggagggtcatattattttcggctttatttatgtaacatttgctagcttgtaaaaggcgaatgtgaaatattgcatctgcattttccaaggctgattcgtgtagctacccttgccacagttgtgacggatgtatggatgttcttgaacatttcagaaggagtggtagaaaaaaacacacattcagccaaccacttatatgaattgaatgtatcagaagtgtactgaagggactggagatggttttcctcagatgagggggccccaaaattgatagtgcacatctgcacgctttctgcgaggcctcagaacttcccagggcccctccctcaaattgtctccatgggaaacttgacccagtggcaagttgcactttggtgatcttggtggtctacacacccgttctgtggagagtcgatttacataagctgtgtatacacacacacacacacacacacacacccctaccccacactgactgtctaccgacaaagaccctatttcctggcaaacggcctcctgaaccctgactttttgtgtacatacttgtaaacacggatttttctgggttttggtttgctttttccttttttccccctgcccctgttctagcttgttcttcttggtttgctttcaacctgcttgatggatgtctgcagagtgctctctaagagtccacctcagtgcctcgtgtgctcagtggtcatgggaaaggagcgaaggaaccatccttggttctcccagcttggttgtgtagcaatccctcagcattgtttttctcagcttcttggcaaaaattaaaacaacaacaacaacaacaacaacaacaacaaacagaaggataaactggcttgcctgtggaccctccccggctctggggccagtcgagagccactgagggacccagcactcagagacacaacacacatgtgtagctgcttctggctgagtgtgtttcctgtcaccaatggcctgtttggctggacgatgcctcggcttgaccttttttgaaaagtgctggttagttcccgcccctggtaaacctggggtaggtgggggttctgtcttaactcgaggggcacctgggatccaggacgcttctagggggctctggctgcccgtgttaatgaaggacagcgcttccgcgagcaccctgggaactgggtcttgggtagcaaagccctcccagagaaaagattgggcacaactaaggctttcctgagcaggaagggggtgaagaccaatcccttcctttggtcctttggtacgcaccccctcagagctgagatggaagacatggctagttcttttcagccttgtggagcctgtcagtcgccatcatacctcgagtgaggcccagctagataatgacttgtccaagatggcacacgtggaaagttgatctgcaccagaacccggatgactgtcaccttgaagcatcctgttctccttctgtgctgtcccaggaagtgtctggcgggcgtgggcagcacagctctacactgtacgattcactagggcatcctgcgagcctcactagccttctggttcatgcctttgacaagcatttttgtgccccctctgcttactgtgacagtcgatgatgaatcttgcgttgccattttctgctgtgggtaactgcgtgcagtgtcttgccttgctttctcttcttactgtcccacagcttggtttcatgttacaaacagaaaagctcgaggctcccaccccgccacatcccaacttcatttccccctcactgtagcccatttccaccccaccacaaagttgccacaggttttctttgtatagaatatttattttgaagctctattttaatagtatttattttagaaagtctactattgtaagagttcttctgtttgtgaagaaaaaaacaagttaaaaactgaatgtactgatttagaaaatatatataaatatatattgttaaatatacacgggactgccgtt

SEQ ID NO: 186151 - DNA, 2379 bp, Homo sapiens
  Payload ID: 16656
  Gene Symbol: SPRY4
  Gene Name: sprouty RTK signaling antagonist 4
  Uniprot ID: Q9C004
  ENST ID: ENST00000434127
  CDS Start-End: 245-1144
attttcccaggcagtggttgcaacatcgccgcggaggtagcgagctgagctgacagcgcggagctggcgctgtggagcgcagggagccttgccggttcctccgaccggcgtctgcgagtacagcggcggctaacctgccccggcttcaggatttacacagacgtggggcgatgcttgtgaccctgcagctcctcaaaggcccctagaagcctgtttctccgtacagtccaggacctccagccccatggagcccccgatcccacagagcgcccccttgactcccaactcagtcatggtccagccccttcttgacagccggatgtcccacagccggctccagcacccactcaccatcctacccattgaccaggtgaagaccagccatgtggagaatgactacatagacaaccctagcctggccctgaccaccggcccaaagcggacccggggcggggccccagagctggccccgacgcccgcccgctgtgaccaggatgtcacccaccattggatctccttcagcgggcgccccagctctgtgagcagcagcagcagcacatcctctgaccaacggctcttagaccacatggcaccaccacccgtggctgaccaggcctcaccaagggctgtgcgcatccagcccaaggtggtccactgccagccgctggacctcaagggcccggcggtcccacccgagctggacaagcacttcttgctgtgcgaggcctgtgggaagtgtaaatgcaaggagtgtgcatccccccggacgttgccttcctgctgggtctgcaaccaggagtgcctgtgctcagcccagactctggtcaactatggcacgtgcatgtgtttggtgcagggcatcttctaccactgcacgaatgaggacgatgagggctcctgcgctgaccacccctgctcctgctcccgctccaactgctgcgcccgctggtccttcatgggtgctctctccgtggtgctgccctgcctgctctgctacctgcctgccaccggctgcgtgaagctggcccagcgtggctacgaccgtctgcgccgccctggttgccgctgcaagcacacgaacagcgtcatctgcaaagcagccagcggggatgccaagaccagcaggcccgacaagcctttctgacagtttgtgtcgaagccccagtgctctgcctggaaacctggttctcttctgacatctaagaagactgcagcaaggtcagaggttttagcctcctgaggctgaccttgctagtctgcccactccctacccccagcttcggaaaatacagagaccaccaccacgtaccctgtattccccaaggtgatgaagaagcactttggggctttttttcagggtcctgaaactttgtgtcaaacagacaatgcaggggcagggtgtggtttggggggaaatttttctttttcagaagacagaacacagatgtggacacatatccggaaactgcagctgcttgaatgccttcccagcccctccttctccctccctccctccgcccccccccccttcctcttttccattgtctttggctctcacaggagctagctgcctgggaggaattgttaactgagtaccagggtacctttaaagaagacccttggagtcttctataccttcttctccttccccatctcactccaccccactttgtccctgatgtcttggggaaggtgtagaacaccctagcagttcctattgtatatacttgggagccactgagaacagaggacggccagtgagtccaagcctcgttcctccttctgcctccccggagccacaggatggatttaggagccactgctcagtgcacttctcccttccaactgcatcaactaactctcgggggtgttctgctcaccacaccgtccttcggttcttactgagtcacagactcgcctgcccactacgtgtcctgggttctctctactcagatcccttccagaaactttatatgggtagaggaagccagggcggcaaatgcgagaccaaatatcattttgccaatgagtctgaggctgtggtctctggatccagtcattatgtttttatagaataattaaaccggatgctaacggtgttttaaaaaataataataaaacaacttgtttccttttggccacccccaggaagggctgatttcaaaatctgggggcgagcaacctcaaggaacacaatttccctccctatcaacaagaggattttaacagcaaagaagagaggcagcacctcccattggcagaatgaccgctgagccaggctgggtttgggtttcttctcttctgattctgctgctcactgtcatagccttttgtgtatagtgatgtgtctgtatctttaatgtaaatagagagatgatg

SEQ ID NO: 186152 - DNA, 553 bp, Homo sapiens
  Payload ID: 16656
  Gene Symbol: SPRY4
  Gene Name: sprouty RTK signaling antagonist 4
  ENST ID: ENST00000511815
  CDS Start-End: 403-553
ttttatgctatgcaactgccttgcagttgactttttcttgcctggcctctgtaaggcctgaggctcctcggccaccctgtacctccctatcctcgggcaccgagctgtgccaggccccggagcccccaggccgcgctagggctgcggtgggggttgaaggtgcgtttacataacaccaggcgtgtgggagctggaggaagaggttgcgaatgtaggagagataaggctcctgctttccctccttccttcttggtggtaccaggcttgacatcacagagaagaggatagagacgccagcctgtattgagcggtttgcagcctgatgctcagccccctccccacaggtacaaatgcaggcccctagaagcctgtttctccgtacagtccaggacctccagccccatggagcccccgatcccacagagcgcccccttgactcccaactcagtcatggtccagccccttcttgacagccggatgtcccacagccggctccagcacccactcaccatcctacccattgaccaggtgaagaccagccatgtggagaatg

SEQ ID NO: 186153 - DNA, 7780 bp, Homo sapiens
  Payload ID: 16657
  Gene Symbol: SPRED1
  Gene Name: sprouty-related, EVH1 domain containing 1
  Uniprot ID: Q7Z699
  ENST ID: ENST00000299084
  CDS Start-End: 861-2195
ctctcgggcgtgaggagctggcccgctgagctgctggtgggcactggctggcggggaacctgcagccgctcttgtcctctcccgccgcttctcgggatcctgccccccggacccgggcccgcccgctcttctccggccgggtgggaacgatcggtttgcctgcccctcgcctcacacgctccccgccgccccctccacccccctgaggaggagtcccggctggagcgtgtctggaggaatccgccgccgcggggcccctagccctgctctgccggcgcctgaggaccgacccagacgccgccgggggttgaggggcagccggcggcgaggcgggagatggtggggtgggctccggcaggaccgcgccgccgctgcccggagcctgggctcggcacccccccgccggcccccaccgagcggagctctgcttcctcctcgccgcatccctgagggaagcgccgcctctgctcccgggttctccgcccgccgactccttcctggccggaccccgctgcgctccaccccagtggctggaggagcagctctccagtcagcctttgcagcccctctctttttccctttccaccgggcctcctcggatcccttggctgggcactgaggcgggggaagaggctggggtcgccacggcggaggttgctgccgccacccccctgcgggggtggccggggttcccggctgggggggtaccgttctgggtgaggcatccaccatggtgaggcccctgtgccgctgcccccgcgcccccccggccgccgctgcctcctgcccctcggtgctgctgttgctcccccgcctgctgttgctcctccatctccagatcggatcacggtgagggaaagatgagcgaggagacggcgacttctgacaacgataatagttatgcacgagtgcgagctgtggtgatgacccgagatgactcaagtggtggatggttaccacttggagggagtggactaagcagcgtcactgtcttcaaagtccctcatcaggaagagaatggctgtgctgacttttttatccgtggagagcgactcagggacaaaatggtggttttggaatgtatgcttaaaaaagacctcatttataataaggtcactccaacatttcaccactggaagattgatgacaagaagtttggtcttacgtttcaaagtcctgctgatgctagggcttttgatagaggtatccgaagagctatagaggatatttctcaaggatgccccgaatcaaaaaatgaagctgaaggggcagatgacttacaagcaaatgaagaggattcttccagttctctagtgaaggatcacctttttcagcaagagacagttgttaccagtgagccttatagaagctcaaatataagaccttctccctttgaagatctgaatgccagaagagtctacatgcaaagccaagccaatcagataacatttggtcagccaggcttggacattcagagcagaagtatggaatacgtacagcggcaaatatccaaggaatgtggaagcctaaagtcccaaaatagggtccctttgaaatcaatcagacatgtcagctttcaagatgaggatgagattgtcagaataaaccctcgagatatcttaatacgtcgctatgcagactacagacatcctgacatgtggaaaaatgacttggaaagagatgatgctgattccagtattcagttttctaaaccagacagtaaaaaatcagactatctgtactcttgtggggatgagactaagttaagttcacccaaagactctgtggtatttaagacgcagccttcctcattaaaaattaagaagtcaaaacgaagaaaagaggatggtgaacgttctcgctgcgtatactgccaggaaaggtttaatcatgaagaaaatgttaggggaaaatgtcaggatgctccagaccctattaaaagatgcatatatcaagttagttgcatgctctgtgcagagagcatgttgtatcattgtatgtcagactcagagggagatttttctgatccctgttcgtgtgacactagcgacgacaagttctgcttgcgatggttagccctggtagctttgtctttcattgtaccatgtatgtgctgctacgtccctttgagaatgtgccatcgctgtggtgaggcatgtggttgctgtggtgggaaacataaagctgctggatgaaatggtccagtgccaaaatgagcttaaaatctttgtttccaggaattagctaacttggatttgtggaagcttttggcaagcaatatggaatcttgcctggtatcattgagcccacacatggaggaagcagaactcatcagttcttggcgtttcacgccatgcctaacttttcccttgagtgcatggcatgttttgttacaggttgtagagtatttgcagaaggaaaccatttctggttatttggctataaaaagtcagcataaaatatgatccaactaaaagggattaatttttggcatttttgtatatttatgcattaggtgatgggacttttaaaggtttgaatttattaggacacgaactaaaaataaaagtgcactaggggacagttgatttcaatctaagaaaagttaacacttgggaattacaagaagtaaaacaagtgcaactaaatcatttattagttgttttttgaaagcagttttatgtataaataacaaatgtttatatttaactaaatgtaaggtacgaattattacatattaaacttttcttccccttcctagttctgaagtagatatatatatatatatatctactgtcacattccatatattttgaatatttaactcatctagttaataatgtttttattccatgcgaatgatttgatattttcatccttatttctctttggctacaatttatattgagttatatctgtacattctggtaatctaaaatccttaaaaatactctaatagccttgagtgaccaactttttttttaaagcacagatgtaattgtctaatgttctgatgggaacgtaacacttatttttatataaaaagagactgagtaaacaaacattatagaaaaaaagtgaagttttttagttgttttttgtggtattcaaccagcaagttgttttctttcagagtttcctccttcaaaaagttatattgcatttacaaatgttttacaaggcagaaagtttgactggatagttagtgtaaaagcttcatgttgagatcttcacgtatcattctgctaaaccagaatatgttcagctgtgttactaatttttcagcttaatcctcagtgcttattatttacataacaataactttttatcagttacattttatttttatttaaactggccaaaagcaaaattattttatgttaaaatgtgtgctaaactatcccaggaaagtatttaatccaacattgtaaatgaagtatcttgtacatataaatttatttcttttgcagagcattatattactggatgtttaatttacaaaatagttgggtaaatgttccaacaaactttaaagtaccttgaagtcaaattgtctgtttttgttttgttgttgttgttgttgttttcttaagtgttacattaaaactctaaccaaggaaagggttctttaagaacattcccttagagggataaagttgagaagtgtgccttttttttaatggcttgaagtttcagaggtgataaaaattaaaatcacactactatttgaagctcattttctatgcaggtttttaaacgtcatttatgtatcattctttttatatatcacacttaagcttgtgttagcttttttcttttgccccagatcaaactgaacaatgtatataacactatctgtctgtaaaatactttttttaagaaagcatttatatttatatgacagcttgaactgacaacattgtgtatatagatcatcttgaagtattatttcacattgaaaagaagaaaatatattgataactatagatgttatgaagaagagggtatttctagttttgtactaaaaatcaattggatgaactaaatccaaaacatgacactgtaggcagcagttttaagtcttatttttactgtttatatatttgaatgctgctacaacagatgatcttcatccctgaagttttcagctaaacttggtttcctagaatagactgttaactttcaaaatttttattggtgaaatggaaatactgtttttccttgtgaatgaattttcatatttgtaagtgctaagtttataattcaggtttgatcaaggtgtgaataactgaagaaaataacttgctggctatataggaaaatgctgtggaaatgaactgtgtatatacttctgggaggaacaaatttaatcatttcttctgttaagcactaatcagtatagtgcaactcctggttctgtactgtattttatatgcaacatatatgctttaatattttaatgtttgtgcattaatattttcaatttgtttaaccactttgctgctaagattttgccgtcccattcccattttttcctttacaattttaaacaagtttcttcattaaaaactatggtgatgaaatggtttttattttaccttggatctttatagttaacatacccagtttcttaatcagtctacaagactaactgatgatataatgttctctgaatccctatatggaaattttcttttgagtaaatgagaattcctttgtgaaagcaaatgggtagtttaaatcactgattcttaaacatgtgtataggcaccttcaggaacattttctcattctctgtacagattcggcactgccaattggcttttcctctaaaacttttctttgtttttatctgatataagcagatggctcaagacaactgcttgagtaatagtattgaaaatggaatcatctagacggcatgacaagcaagactggtctgatgaacttgttcagaattgataattcttaaatatttctcttggcttcaaaagggacatcatttgatttctgaagaagtatgtcgtgtggagcttcagcaccacctactggatgatttccaggccagagacatgagatggcaatagggatctgacagggttcatcactactaccattaaagggctatttatgtggtgaccacctctaccagggaaaccaggaataagaactgtctcaaaggaattgtaaaatggttatttacctaatgtgtcttgttggcttgctgaaagattttaagcacttttttcttacatatcctgttttaaaatatttgttgatatttgggactggcaatcaaacttaatggatgtactgaggcatttatagaaccagttgctttaactctcaaaagccattaccaaaatggtatttttttcctccttccgccagtcagggagaatttttaaaaataataatcaaaacatgaaaaaacataatcacacctgtattttatcatgacagcttcagagagtgtgtgtgtacgtttttctctcttttatttgagacggagtttcactcttgttgcccaggctggagtgcaatggtgcgatctcagctcactgcaacctccgcctcctgggttcaagcgattctcctgcctcagcctcccaagtagctgggattacaggcacccaccaccatgcccagctaagttttggtattttagtagagatggggtttcaccatgttggccaggctggtcttgaactcctgaccttaggtgatccacccacctcggcctcccaaagtgctgggattacaggcatgagctactgcgcccagccgtgtgtatgtttctgaaatgatgatggggtggggttaaaatctaaagggaaaaacttgaaactacctattttcattggttattcagcagtgcctaaaatgagcttttgaagtaatgtaaatgcactttcaattcatgtgtatagtgccatctgatatcttgggtaagtcttgctttttcttttctttttcctctcccctgcccccttaattaaatggcacggaaatgtttcttaatatgcacgtgagtctccagagtacaggaaatgtgctttcctctaaatggtcaatgtaaagaatcttaaggatatttcttgtgttgaaatttacattcgattttgtgattacacttggaagtatgtgttaaattgggtttttaattgtagcccaaaggtgcattaagcaagtgtaacattttttccacataaaacttagaaaactttagttacctgaaaagcaaggattctttactaattattatgctcattcttgatttgacttccatgttcacacttcaaagtgtaagaggaagcactagaaactggcattattgttgcactaaaaaagtctataaatcataatagcaccatgaggtgttttgcaatgagacaaacatgaagaatgaatttctttaagagagaaacacaaccggaggtgatttatataaaccaaaagaaaaaaaaaggctttaaggtattaggtactgtttgcctagcagccaggtggttataaaagattcatatgctttggtacactgataaatgttagccattattcctgaaagcttcttaaattgcatcagttgttttgaaattttttcaagaataaactagttgaaaagtctttgtattaaaaatacacatagatttttgtgaacatttccagtgtgtagtgtcgtttgctttctatttctgacctcaaaagtgcctcacttgtatattatttccattaaaagcttgactgcattctttctaatgaacaatgaaaaactgtttaactcatgtcataatgtgtctcctcagatatagttaactagcttgatagttttgagtatataatgtaaataatacattataagtttgtaaccatttctgttacttcatacccgtgtaattggacatagcagatgattatcataagaatttgttttaatggtttttttccctcctggaattacctgattaaacctgtcatgaattataaaaggactttttcttattctcctagagcttatcaaattatcacataagagataattactggaggagaaagtaaaaatggaagcttttgataattagctctgttctttaaaagtatacttttaaactgaaagttcacatatagttcatcttaataacatatttattcatccttaattgtattcagatttttttttaagtctctaagctaataatgttatatttattggtttggtaacatgttgcagctaagctaatgaccttaagtggcaattgtttaacccaggactactgatttttttatattcaagtcagtttcatcgttttacttaactcgccatataaccaaaaataacgaataatctaaaggaaaggttattaggacagtaataaaaaattatagtgtatctcaacactagaataagttggattactatattatagtttatttgaaaaatcaaggagtaactgtatctttaccattaattatgaaatgtagtctcatgtgcttatttacaggtttttcagaatttgctttacattcttcacatcaagttaatacccacaagtaagtagaatagcttttataacaaggaaattgaaactagggttctagcttggctatcaatataagtgtcatgcacatagtgctccttaaagaaaaagacatcgacatcaatggtatgaaagctgtagtcactctttaaattgaactgctctaagatttgcagttttagtgagatctgaaatgatggttcaaaaaatacattcataataaaagtcttaacaaaatcaca

SEQ ID NO: 186154 - DNA, 527 bp, Homo sapiens
  Payload ID: 16657
  Gene Symbol: SPRED1
  Gene Name: sprouty-related, EVH1 domain containing 1
  ENST ID: ENST00000561317
  CDS Start-End: 133-527
gaaagatgagcgaggagacggcgacttctgacaacgactacagcaattcaattctgaattcttctgcagtccctcacagctcagccttgaaacccactctttaatagttatgcacgagtgcgagctgtggtgatgacccgagatgactcaagtggtggatggttaccacttggagggagtggactaagcagcgtcactgtcttcaaagtccctcatcaggaagagaatggctgtgctgacttttttatccgtggagagcgactcagggacaaaatggtggttttggaatgtatgcttaaaaaagacctcatttataataaggtcactccaacatttcaccactggaagattgatgacaagaagtttggtcttacgtttcaaagtcctgctgatgctagggcttttgatagaggtatccgaagagctatagaggatatttctcaaggatgccccgaatcaaaaaatgaagctgaaggggcagatgacttacaagcaaatgaagaggattcttccagttctctagtgaa

SEQ ID NO: 186155 - DNA, 4097 bp, Homo sapiens
  Payload ID: 16658
  Gene Symbol: SPRED2
  Gene Name: sprouty-related, EVH1 domain containing 2
  Uniprot ID: Q7Z698
  ENST ID: ENST00000356388
  CDS Start-End: 191-1447
tgcaccccttcccccaaaccctatcccgcgccctgcttccccttctgctgcggcgccctcttcatctctagccgccccccctccccaaatcaggcgatctccggagatgtgaagaaggggggcgagcggacaggaagatgaagggagcaaagctgcccgccgcgggacaggcgtctaggtgaacaagaaaatgaccgaagaaacacacccagacgatgacagctatattgtgcgtgtcaaggctgtggttatgaccagagatgactccagcgggggatggttcccacaggaaggaggcgggatcagtcgcgtcggggtctgtaaggtcatgcaccccgaaggcaatggacgaagcggctttctcatccatggtgaacgacagaaagacaaactggtggtattggaatgctatgtaagaaaggacttggtctacaccaaagccaatccaacgtttcatcactggaaggtcgataataggaagtttggacttactttccaaagccctgctgatgcccgagcctttgacaggggagtaaggaaagcaatcgaagaccttatagaaggttcaacaacgtcatcttccaccatccataatgaagctgagcttggcgatgatgacgtttttacaacagctacagacagttcttctaattcctctcagaagagagagcaacctactcggacaatctcctctcccacatcctgtgagcaccggaggatttataccctgggccacctccacgactcataccccacagaccactatcacctcgatcagccgatgccaaggccctaccgccaggtgagcttcccggacgacgacgaggagatcgtgcgcatcaacccccgggagaagatctggatgacggggtacgaggattaccggcacgcacccgtcaggggcaagtacccggacccctcggaggacgcggactcctcctacgtgcgcttcgccaagggcgaggtccccaagcatgactacaactacccctacgtggactcctcagactttggcctaggcgaggaccccaaaggccgcgggggcagcgtgatcaagacgcagccctcccggggcaagtcgcggcggcggaaggaggacggagagcgctcgcggtgcgtgtactgcagggacatgttcaaccacgaggagaaccgccggggccactgccaggacgcgcccgactccgtgagaacttgcatccgccgggtgagctgcatgtggtgcgcggacagcatgctctatcactgtatgtcggaccccgagggagactatacagacccttgctcgtgcgatactagcgacgagaagttttgcctccggtggatggctcttattgccttgtctttcctggccccctgtatgtgctgttacctgccccttcgggcctgctaccactgcggagtgatgtgcaggtgctgtggcgggaagcacaaagcggccgcgtgactcagtttccctcccttctccctccatccgcagccacaggggaactcgtctcttacatactctcatcttctcccccgctcccttccactccaaggagcgaggagggcaagcggcctcccagctccctggtacctcgaggcaccattccagccagggacgctgccgggtagactctccactccccctgccgcccacactgcagcagccacatccatacacacacgctcgcacagtgttctgaggaaggaaccttcgccacagactcctgtactattaacaatctgtaaccaagctaactgtctcatccatgtgttgatttcctgtttcctcctcccccgcctcttccagttcaaaggagtctgcaattggaactgctgattttcggtgggttttgtagttgatttttccaagagcgtcgaagactctctttctcttggttcaccttgcctgtcgctagcaagcatctggttcagcggaaatgggatgtgagaatgatgaaacccgacagaagtatctcagcctgcagtcagttattatgtataggaggtgagctagttaacaaacttgtaccacaaaacaatatcgctttaacttttctaaagccaaatttcccatgtaagctgcagtttctatctttagcccatcatcattttctgcccccccaaaatctgttgaaatgattcactgatgcaaaacattcacccgtaatagactgagaattgagccttaacttcagattaacttgtgagaatcaggaaaattccttcaactgcattgcatcctcttggaccagggctagaatggggatttcaggtttctatgagcctccccattacccctaaagtagaacattttttaaattgtgttgccaccacttctaaaaatttagcaatattagaataggatactagtgaagtaagaaattttgcttgttgttttgcaaaccaaatagtttcctcaaacacaaatcagtgttcccacgaacaagttccagttgagaaacactaaggttatggtgaataaaaccatagggagcttcttccccccaacccctggctattttatattaatggggagaggggatttttaaatgtcataaatttgaagagtggtgggttgcattttcttcatgggtttatgttttcgtttcattttggactcaatttcacatcaccaaattcctcatttatacttggggaaaaaacaaggccatatgtaaaaacccttccaatgcctaagtgtctttctcctgcaactccaaacccagactcgccactttgggtgcacaggtggttaggtcagccaactggttctgcctgtcgccttgccacggaggaggcttctaattagctggaaaagagtatttttctaatacgttgcaaggattagccaaatcttcttattgaagaaagaagaaaagtgaagagtggttacctatacctagcatagtacaatcagaacctcgtggagaccaccggggacaggcttgcggacgccggctgttcttcccgccacgatctttctgtggtagcggccagcagaagacatggcctgctccccactccctttccccactccttctttattgcacacaggacaccagtcttcaaggaaagggacttttttccagtctgccaatcatattgggaaagtgctagctgtgctcaccttcatggggctgtttccagctcgtccacaagctcatcgattttctttagtagattaccggtgtaaatacccagtgtgcttatgagtcagttagtagacgtcttcattcattggagtaactggtttaggctttccagtttggaaaaggagcagagagctgtccatctggattgatggaagaaaagagaacctcatccatgcctggagaacatctagaaaaccttcagccagcctccagtgctgtcgagagaccaccttcccccgacccggaggcacttccttggggtctttctctagggtctcttctctacaaagcacaacactaatgttcgtttccttagacctcagttcaagtgcccctatttatttcaataagaacgcacatatcccagctgttttttgtttgtcacctctatttagttgttacctgtttctctcttctttcaccccttgtccttttccacccttttaagagttacgctagcagatcttactccacgtatactttttggtttgtgaaggcatcggttaagggcacaaagacagccatggggacatttatgtaaatacgtctctaattgccacactgcagctgaacagtgtgtagtattttcccagtcagctttgccatactgacgtcaatcatttgagagaaattattcagattttatttttgtatctgtggtaacaaaacattaaccaaaagattttctgtccagaagcctccccgaccccccaagctatttgctcacattaacaaattaaagtgcctgaagcataattcattctttacctgtatactaaaaaccctgttgtattgatttttttataataagcctttttacctctgtgtaaaaaatatatatacaagtgtatgatgtacattttagttcttaacttttttttatggtttctaatatgtatgaccaatgtagccattgctttaaaatgtaccgtgtaaatataaacacatcctatcaga

SEQ ID NO: 186156 - DNA, 1365 bp, Homo sapiens
  Payload ID: 16658
  Gene Symbol: SPRED2
  Gene Name: sprouty-related, EVH1 domain containing 2
  ENST ID: ENST00000452315
  CDS Start-End: 68-1365
ccaggacttgtgttctgatggaaggaccagccaacacccacacagccttcctttccttggtgtgcagatggctctatgcagtcttatctccagctgggcatctgggttcaggtcagacgatgaccaggaaaggaggggtgacagctatattgtgcgtgtcaaggctgtggttatgaccagagatgactccagcgggggatggttcccacaggaaggaggcgggatcagtcgcgtcggggtctgtaaggtcatgcaccccgaaggcaatggacgaagcggctttctcatccatggtgaacgacagaaagacaaactggtggtattggaatgctatgtaagaaaggacttggtctacaccaaagccaatccaacgtttcatcactggaaggtcgataataggaagtttggacttactttccaaagccctgctgatgcccgagcctttgacaggggagtaaggaaagcaatcgaagaccttatagaaggttcaacaacgtcatcttccaccatccataatgaagctgagcttggcgatgatgacgtttttacaacagctacagacagttcttctaattcctctcagaagagagagcaacctactcggacaatctcctctcccacatcctgtgagcaccggaggatttataccctgggccacctccacgactcataccccacagaccactatcacctcgatcagccgatgccaaggccctaccgccaggtgagcttcccggacgacgacgaggagatcgtgcgcatcaacccccgggagaagatctggatgacggggtacgaggattaccggcacgcacccgtcaggggcaagtacccggacccctcggaggacgcggactcctcctacgtgcgcttcgccaagggcgaggtccccaagcatgactacaactacccctacgtggactcctcagactttggcctaggcgaggaccccaaaggccgcgggggcagcgtgatcaagacgcagccctcccggggcaagtcgcggcggcggaaggaggacggagagcgctcgcggtgcgtgtactgcagggacatgttcaaccacgaggagaaccgccggggccactgccaggacgcgcccgactccgtgagaacttgcatccgccgggtgagctgcatgtggtgcgcggacagcatgctctatcactgtatgtcggaccccgagggagactatacagacccttgctcgtgcgatactagcgacgagaagttttgcctccggtggatggctcttattgccttgtctttcctggccccctgtatgtgctgttacctgccccttcgggcctgctaccactgcggagtgatgtgcaggtgctgtggcgggaagcacaaagcggccgc

SEQ ID NO: 186157 - DNA, 467 bp, Homo sapiens
  Payload ID: 16658
  Gene Symbol: SPRED2
  Gene Name: sprouty-related, EVH1 domain containing 2
  ENST ID: ENST00000427238
  CDS Start-End: 1-143
tcatgcaccccgaaggcaatggacgaagcggctttctcatccatggtgaacgacagaaagacaaactgcttcaaaagttagaaccccggagctggtgccaaattgtaaaacgtgactgtcctttccagcaaagtctcttttgaccacacgctttatccgagatgcttagaagtatatttggctgttttatttgcatctttgattaagatgtctatcattgtaaaaaggtattcaaaacaaaagtgtactcttttattattatgaatcacattgtactgagctgtgaagtcagtgttttaaaaatgtagagtttattcatggagcatgccattgaggtttggatggtggcaggtaaaacagaaaggcaagatgtcatctgacattaggctacttataaataaatgtttatctagcttttatttcatgccctaatgaataaaacatgcttggaaaaagaaagtaacaag

SEQ ID NO: 186158 - DNA, 1800 bp, Homo sapiens
  Payload ID: 16658
  Gene Symbol: SPRED2
  Gene Name: sprouty-related, EVH1 domain containing 2
  Uniprot ID: Q7Z698
  ENST ID: ENST00000443619
  CDS Start-End: 45-1292
aataatgctaatacccagcactcgggctccacaatgtagaggaaatggcatcgcctggcagtgacagctatattgtgcgtgtcaaggctgtggttatgaccagagatgactccagcgggggatggttcccacaggaaggaggcgggatcagtcgcgtcggggtctgtaaggtcatgcaccccgaaggcaatggacgaagcggctttctcatccatggtgaacgacagaaagacaaactggtggtattggaatgctatgtaagaaaggacttggtctacaccaaagccaatccaacgtttcatcactggaaggtcgataataggaagtttggacttactttccaaagccctgctgatgcccgagcctttgacaggggagtaaggaaagcaatcgaagaccttatagaaggttcaacaacgtcatcttccaccatccataatgaagctgagcttggcgatgatgacgtttttacaacagctacagacagttcttctaattcctctcagaagagagagcaacctactcggacaatctcctctcccacatcctgtgagcaccggaggatttataccctgggccacctccacgactcataccccacagaccactatcacctcgatcagccgatgccaaggccctaccgccaggtgagcttcccggacgacgacgaggagatcgtgcgcatcaacccccgggagaagatctggatgacggggtacgaggattaccggcacgcacccgtcaggggcaagtacccggacccctcggaggacgcggactcctcctacgtgcgcttcgccaagggcgaggtccccaagcatgactacaactacccctacgtggactcctcagactttggcctaggcgaggaccccaaaggccgcgggggcagcgtgatcaagacgcagccctcccggggcaagtcgcggcggcggaaggaggacggagagcgctcgcggtgcgtgtactgcagggacatgttcaaccacgaggagaaccgccggggccactgccaggacgcgcccgactccgtgagaacttgcatccgccgggtgagctgcatgtggtgcgcggacagcatgctctatcactgtatgtcggaccccgagggagactatacagacccttgctcgtgcgatactagcgacgagaagttttgcctccggtggatggctcttattgccttgtctttcctggccccctgtatgtgctgttacctgccccttcgggcctgctaccactgcggagtgatgtgcaggtgctgtggcgggaagcacaaagcggccgcgtgactcagtttccctcccttctccctccatccgcagccacaggggaactcgtctcttacatactctcatcttctcccccgctcccttccactccaaggagcgaggagggcaagcggcctcccagctccctggtacctcgaggcaccattccagccagggacgctgccgggtagactctccactccccctgccgcccacactgcagcagccacatccatacacacacgctcgcacagtgttctgaggaaggaaccttcgccacagactcctgtactattaacaatctgtaaccaagctaactgtctcatccatgtgttgatttcctgtttcctcctcccccgcctcttccagttcaaaggagtctgcaattggaactgctgattttcggtgggttttgtagttgatttttccaagagcgtcgaagactctctttctcttggttcaccttgcctgtcgctagcaagcatctggttcagcggaaatgggatgtgagaatgatgaaacccgacag

SEQ ID NO: 186159 - DNA, 555 bp, Homo sapiens
  Payload ID: 16658
  Gene Symbol: SPRED2
  Gene Name: sprouty-related, EVH1 domain containing 2
  ENST ID: ENST00000440972
  CDS Start-End: 207-555
cttctccctttttttcggtcgcaagtaggaagctttttgcactccaccacctctggccgctgggaagacgtcatcgcttccgccctacttcctcctcctgttggcggcggcgatctccggagatgtgaagaaggggggcgagcggacaggaagatgaagggagcaaagctgcccgccgcgggacaggcgtctaggtgaacaagaaaatgaccgaagaaacacacccagacgatgacagctatattgtgcgtgtcaaggctgtggttatgaccagagatgactccagcgggggatggttcccacaggaaggaggcgggatcagtcgcgtcggggtctgtaaggtcatgcaccccgaaggcaatggacgaagcggctttctcatccatggtgaacgacagaaagacaaactggtggtattggaatgctatgtaagaaaggacttggtctacaccaaagccaatccaacgtttcatcactggaaggtcgataataggaagtttggacttactttccaaagccctgctgatgcccgagcctttgacaggggagtaagga

SEQ ID NO: 186160 - DNA, 701 bp, Homo sapiens
  Payload ID: 16658
  Gene Symbol: SPRED2
  Gene Name: sprouty-related, EVH1 domain containing 2
  ENST ID: ENST00000421087
  CDS Start-End: 1-701
gtggtattggaatgctatgtaagaaaggacttggtctacaccaaagccaatccaacgtttcatcactggaaggtcgataataggaagtttggacttactttccaaagccctgctgatgcccgagcctttgacaggggagtaaggaaagcaatcgaagaccttatagaaggttcaacaacgtcatcttccaccatccataatgaagctgagcttggcgatgatgacgtttttacaccgatgccaaggccctaccgccaggtgagcttcccggacgacgacgaggagatcgtgcgcatcaacccccgggagaagatctggatgacggggtacgaggattaccggcacgcacccgtcaggggcaagtacccggacccctcggaggacgcggactcctcctacgtgcgcttcgccaagggcgaggtccccaagcatgactacaactacccctacgtggactcctcagactttggcctaggcgaggaccccaaaggccgcgggggcagcgtgatcaagacgcagccctcccggggcaagtcgcggcggcggaaggaggacggagagcgctcgcggtgcgtgtactgcagggacatgttcaaccacgaggagaaccgccggggccactgccaggacgcgcccgactccgtgagaacttgcatccgccgggtgagctgcatgtggtgcgcggacagcatgctctatca

SEQ ID NO: 186161 - DNA, 498 bp, Homo sapiens
  Payload ID: 16658
  Gene Symbol: SPRED2
  Gene Name: sprouty-related, EVH1 domain containing 2
  ENST ID: ENST00000426832
  CDS Start-End: 1-312
ggggtctgtaaggtcatgcaccccgaaggcaatggacgaagcggctttctcatccatggtgaacgacagaaagacaaactggtggtattggaatgctatgtaagaaaggacttggtctacaccaaagccaatccaacgtttcatcactggaaggtcgataataggaagtttggacttactttccaaagccctgctgatgcccgagcctttgacaggggagtaaggaaagcaatcgaagaccttatagaagaagtagagaatggattctggcgggcccagaaggctcctggcctacccactgtcctcctgtaatcagaggcccagggtgtacagctgccactgaaaaggaaagggatctgtgacctctggagccctggttcggtttaggccttggtctatggcagcgagtgcagaagtttgagagattaattgggaacaacagcaggcaaagttaatttagggagcatcctggcaagaatcaattaaagaagagtaaat

SEQ ID NO: 186162 - DNA, 4778 bp, Homo sapiens
  Payload ID: 16659
  Gene Symbol: SPRED3
  Gene Name: sprouty-related, EVH1 domain containing 3
  Uniprot ID: Q2MJR0
  ENST ID: ENST00000338502
  CDS Start-End: 104-1336
aagttggaggggagatgagggttgagggaacattccatgggagagcagggtttgagctcatgactgtgttgtccctgtccttccccccacctcctgcaggtacatggtgcgggtccgagctgtggtgatggcccgagatgactccagtgggggctggctgcctgtggggggcgggggcctcagccaggtgagcgtgtgtcgggtccgaggggccaggcccgaggggggggcccgccaggggcactacgtcatccacggggaacgcctccgggaccagaaaacaaccttggagtgtacactgaagccaggcttggtttacaacaaggtgaatcccatctttcaccactggagcctgggtgactgcaagtttggactgacgtttcagagccctgcagaggctgatgagttccagaagagcctgctggctgcgctggccgcactgggtcgaggctcactcaccccctcctcctcctcctcctcctcctctccttcccaggatactgcagagaccccctgccctctgacgtcccacgtggacagcgactcctcctccagtcacagccgccaggagactcctcccagcgccgctgcggcccccatcatcacgatggagtcagcttcaggcttcgggccgaccacgcccccccagcgccgccgctcctccgctcagagctaccctccgcttctaccgttcacggggattccggaaccctcagagcccctggcaggggcagggggcctggggtggggcggccgcggctacgaggattaccggcgctccgggccacccgcgcccctcgccctgtccacctgcgtcgtgcgcttcgccaagaccggcgcgttgaggggcgctgccctgggtcccccagcggcactacctgcccctttgaccgaggctgcgcccccagcgccccccgctcgcccaccccccggcccgggcccatcctctgcgcctgccaaggcctccccggaagcggaggaggcagcgcgctgcgtgcattgccgcgcgctcttccgtcgcagagcagacgggcgtggcggccgctgcgcagaggccccggacccgggtcgcctcctggtgcgccgtctaagctgcctgtggtgcgccgagagcttgctctaccactgcctgtcggacgccgagggcgacttctcggacccgtgcgcctgcgagccgggccacccgcgccccgccgcgcgctgggccgcgctggccgcgctctccctggcagtgccctgcctctgctgctacgcgcccctgcgcgcgtgccactgggtcgcagcgcgatgcggctgcgccggctgcgggggtcgccacgaggaggctgcgcggtgaggacggcctggtgggtcccctagccggcccgaggacccaaaattgagggtccaggaccccggactccgttcggacctaaaacccaaacctaggcacatccggaacttggagcttgagtttggattgagagatctcagacctggaacctggaacccaaacctaggactgagagaccccagccccagcttcattggggtgtctgtctaagaagtcccaggcgtcctgagttctggcgttcccccacccccacaccccacgaggaggctccaggcgtccccatactttgcatctcagaaaggccagggagcacatagatcccgaaaagggcaggtccctgttgaaatgaacaacctagaacccggtcacgcctggcaccatgtccctcagattacagccccacaattagtcaggacttgcccataactggctctgcctttattcaactcccagatcagatcttgagaccataggacctggagtcacccacaaacagttcctgaatattcacctaagacctggtgcccccacatctgagacattctcatagtcccaggacccctgagacagcaggacccctgagaaagtttcaaacagagtttgaaactctgttatgctctggaatctccagatgctgcccctcaaatctacccacgacttagtgcccacagacctggcctccagtccgggaacactgaagtctaagatgtccagggaactcccagacaccctgggaccccagactcttaagatgcactgagtgctcggatatactgaaacacgagctgttctcttaccaaaatgacttgggagacccatcccagagcccccaagatccagatatcagacaccaagatgctctggaagccagggatcaaagacctccataggtccacccacccccaagccagggttctcaggagctttggatatcatttataggactcagaggtgcctggggtcctcagatgtgcgactgaaggccaccaacacctcaggacccgagatactggtctcgagttctcaaatagccctctcttgcagtccctcctggacctggattttgagaccccaaatgtcctggaatcttcagcttctttctacccacagattcccaaccccttaagggctgggagtccagctcccagaagaggggatgctcatggtgacccagacctctgatgcccttggccctcagcccttgagtgaccctaaggtactttaggagcactggatccaataccccaaaggtgccactgacccccaaatgcaaggctcaagaccctacaacattgggattgttcctgatccaagaccttcatccctccataccagaggcgttcagattcgaggtgccccaagaccccagcaccctcagaccccagatttctttggattcaaacctctctagtctgatgaaccccaagttgcctctacacctgattcccccatccccacttgtcggacctcagagacctgctgccccttgaatcctgtcatccataggcccctaaaaccccaaggttccagcctctggaattctggtcccaaggatcccagcccaagcccccagcaatcctcagaattacccctttatcttagggtgggatccctaccatttggaactcattgtaggaccacccagggtggggcacagtggctcatgccttgtaatcccagcactttgggaggccaagggaggaggatcgcttaaggccaggagtttgagaccagcctgggcaatgtagtgagaccgtctctaaaaaaaaaaaaaaaggaccaagtaggagctccctcactgtcacgtctaggacccagcattgtcacagatgattatgcagggtcttcattaagtgaaggcacacagcccagggtttcgaggagctggaagtcacaccagtctgctggccacactgtgccctcagaagaagtgtgtgcaatggaaactttcaggctagttatggctctgctgtcccacagcccccagtcttgcagaccttccttcaagcacaaccttaattcctagtccaggttcaagtcccaccttttatgttctccccctccattaaccccttctcttcctatttatttatttatttatttatttattttgagacagagtctcgctgtatcacccaggctggagtgcagtggcacaatctcggctcaccacaacctccccctcccgggttcaagccattcgtctgcctcagcctcccgagtagctgggataacaggcatgtgccaccacacccagctaattttttgtattttgagtagagacagggtttcaccatgttggccaggatggtctcaaactcctgacctcatgatccacctgcctcagcctcccaaagtgctgggattacaggcatgagccactgcacctggctctcttccactttagagtgagaagttgcttcaggaagtttgaaagcctgtttcatggcccactgagtctcttctgtgcaaaggggggtgccacaggcttttttcccccaagtgaaatggggcttccagtggatcgaagatctggtgtcctgtatgggggcctcaaggtcttggagcaagacagtctcaatgttgtatgggcttgggacctgcatctggccccaagcatctggaactgtgcacttaacctttcttcattacccagacttggatggccttgttggggttcaagggataggtcctctgtctcttcctttaaattattaactatttattacatccggaacctgtgagattcagcactcccaaccagaccctgggatgggtgagagaaaagcgggggtgtctctcccctccccactctgcccagctctcatcactgtcagacccaccagagctgagggcggagggattgggggctggggcagcctgggtccccatgcccctctctgtgcctcggtctccccccttccatggtgggcgggggggaagctccattcttaacctacctcgttttggggaggggtgggacgggggaccagagtgctgtacggtgctgtgggatctgcagatgaagcggtgggggctaaggaaaggtcccctggccgccacttcccagcagcgcctctcccaggtcccccagtcctgctccctgctgagacccacctctgatccatgattccccttcattgcccccaaatcaggggtacatggagggccgccctgggagccaggcagacctcagaccctggagcccccaggcccaatttcccagccgcttgcccctcagatcggatgcttggcccccagatttgggggaggcaccccaacatatatcttcctgatcttgtttctaagccagtctgtgacctcaatattgttagtgtcagtgcaggctgaagtggtgggggaggatgggggccaaagacccagccttgtcatcgggggagggggcacgagatctgctccaagaaatgtctgtgacaaagtctca

SEQ ID NO: 186163 - DNA, 478 bp, Homo sapiens
  Payload ID: 16659
  Gene Symbol: SPRED3
  Gene Name: sprouty-related, EVH1 domain containing 3
  ENST ID: ENST00000586958
  CDS Start-End: 5-370
gtacatggtgcgggtccgagctgtggtgatggcccgagatgactccagtgggggctggctgcctgtggggggcgggggcctcagccagacaaccttggagtgtacactgaagccaggcttggtttacaacaaggtgaatcccatctttcaccactggagcctgggtgactgcaagtttggactgacgtttcagagccctgcagaggctgatgagttccagaagagcctgctggctgcgctggccgcactgggtcgaggctcactcaccccctcctcctcctcctcctcctcctctccttcccaggatactgcagagaccccctgccctctgacgctctcccagtacttcaggcatatgctgtgcccttgacagtggccctaaccgcatccttatgaataggtactcttaggatccccgttttacagaggaggaaactgaggctcaaagagtcccacgtggacagcgactcctcctcca

SEQ ID NO: 186164 - DNA, 1366 bp, Homo sapiens
  Payload ID: 16659
  Gene Symbol: SPRED3
  Gene Name: sprouty-related, EVH1 domain containing 3
  Uniprot ID: Q2MJR0
  ENST ID: ENST00000586301
  CDS Start-End: 131-1363
ctctggatgtgtcttcggtcgcccgtttctgacttcctctgcctccgtctccctctgagcctctctttctggccatttctggttctctccctgttccctgcccatctcccgttgctgggtgactcagtacatggtgcgggtccgagctgtggtgatggcccgagatgactccagtgggggctggctgcctgtggggggcgggggcctcagccaggtgagcgtgtgtcgggtccgaggggccaggcccgaggggggggcccgccaggggcactacgtcatccacggggaacgcctccgggaccagaaaacaaccttggagtgtacactgaagccaggcttggtttacaacaaggtgaatcccatctttcaccactggagcctgggtgactgcaagtttggactgacgtttcagagccctgcagaggctgatgagttccagaagagcctgctggctgcgctggccgcactgggtcgaggctcactcaccccctcctcctcctcctcctcctcctctccttcccaggatactgcagagaccccctgccctctgacgtcccacgtggacagcgactcctcctccagtcacagccgccaggagactcctcccagcgccgctgcggcccccatcatcacgatggagtcagcttcaggcttcgggccgaccacgcccccccagcgccgccgctcctccgctcagagctaccctccgcttctaccgttcacggggattccggaaccctcagagcccctggcaggggcagggggcctggggtggggcggccgcggctacgaggattaccggcgctccgggccacccgcgcccctcgccctgtccacctgcgtcgtgcgcttcgccaagaccggcgcgttgaggggcgctgccctgggtcccccagcggcactacctgcccctttgaccgaggctgcgcccccagcgccccccgctcgcccaccccccggcccgggcccatcctctgcgcctgccaaggcctccccggaagcggaggaggcagcgcgctgcgtgcattgccgcgcgctcttccgtcgcagagcagacgggcgtggcggccgctgcgcagaggccccggacccgggtcgcctcctggtgcgccgtctaagctgcctgtggtgcgccgagagcttgctctaccactgcctgtcggacgccgagggcgacttctcggacccgtgcgcctgcgagccgggccacccgcgccccgccgcgcgctgggccgcgctggccgcgctctccctggcagtgccctgcctctgctgctacgcgcccctgcgcgcgtgccactgggtcgcagcgcgatgcggctgcgccggctgcgggggtcgccacgaggaggctgcgcggtgagga

SEQ ID NO: 186165 - DNA, 646 bp, Homo sapiens
  Payload ID: 16659
  Gene Symbol: SPRED3
  Gene Name: sprouty-related, EVH1 domain containing 3
  ENST ID: ENST00000587947
  CDS Start-End: 103-646
agaaagggcagacatggagaagaagatagaggtgagagagaagagatggcatgaggaagaaaggagctgtgtggaagacggtggccatggggttgaaggtacatggtgcgggtccgagctgtggtgatggcccgagatgactccagtgggggctggctgcctgtggggggcgggggcctcagccaggtgagcgtgtgtcgggtccgaggggccaggcccgaggggggggcccgccaggggcactacgtcatccacggggaacgcctccgggaccagaaaacaaccttggagtgtacactgaagccaggcttggtttacaacaaggtgaatcccatctttcaccactggagcctgggtgactgcaagtttggactgacgtttcagagccctgcagaggctgatgagttccagaagagcctgctggctgcgctggccgcactgggtcgaggctcactcaccccctcctcctcctcctcctcctcctctccttcccaggatactgcagagaccccctgccctctgacgtcccacgtggacagcgactcctcctccagtcacagccgccaggagactcctcccagcgccgctgcggcccccatcatcacgatggagtcagcttcaggcttcgggccgaccacgccccccc

SEQ ID NO: 186166 - DNA, 1539 bp, Homo sapiens
  Payload ID: 16659
  Gene Symbol: SPRED3
  Gene Name: sprouty-related, EVH1 domain containing 3
  ENST ID: ENST00000587013
  CDS Start-End: 79-1443
cgtagaccaccacctctttagaaccttgagaccagtccctgtccctgccccgtcccctcctcatagcattagagaccaatggcgcagatgggtggaaaagtgggggatcccctctggatcttaagaaaatgggggctggggggttgctctctggagctagtgccgggctctaggacccagcaggcaagtaagcccgcctcgctcttacccctcccccaagccgccccttccccccccacccgtcttccaggttccccctccctcccccctcgccccggctcccggtgcccgtctccagcgccgccggagccagccagggagccggaacgaaaaggaggaggaggaggccgcgtcgccgccgctcggagcccggccggagcctcgcagacaaccttggagtgtacactgaagccaggcttggtttacaacaaggtgaatcccatctttcaccactggagcctgggtgactgcaagtttggactgacgtttcagagccctgcagaggctgatgagttccagaagagcctgctggctgcgctggccgcactgggtcgaggctcactcaccccctcctcctcctcctcctcctcctctccttcccaggatactgcagagaccccctgccctctgacgtcccacgtggacagcgactcctcctccagtcacagccgccaggagactcctcccagcgccgctgcggcccccatcatcacgatggagtcagcttcaggcttcgggccgaccacgcccccccagcgccgccgctcctccgctcagagctaccctccgcttctaccgttcacggggattccggaaccctcagagcccctggcaggggcagggggcctggggtggggcggccgcggctacgaggattaccggcgctccgggccacccgcgcccctcgccctgtccacctgcgtcgtgcgcttcgccaagaccggcgcgttgaggggcgctgccctgggtcccccagcggcactacctgcccctttgaccgaggctgcgcccccagcgccccccgctcgcccaccccccggcccgggcccatcctctgcgcctgccaaggcctccccggaagcggaggaggcagcgcgctgcgtgcattgccgcgcgctcttccgtcgcagagcagacgggcgtggcggccgctgcgcagaggccccggacccgggtcgcctcctggtgcgccgtctaagctgcctgtggtgcgccgagagcttgctctaccactgcctgtcggacgccgagggcgacttctcggacccgtgcgcctgcgagccgggccacccgcgccccgccgcgcgctgggccgcgctggccgcgctctccctggcagtgccctgcctctgctgctacgcgcccctgcgcgcgtgccactgggtcgcagcgcgatgcggctgcgccggctgcgggggtcgccacgaggaggctgcgcggtgaggacggcctggtgggtcccctagccggcccgaggacccaaaattgagggtccaggaccccggactccgttcggacctaaaacccaaacctaggcac

SEQ ID NO: 186167 - DNA, 1667 bp, Homo sapiens
  Payload ID: 16660
  Gene Symbol: SPRTN
  Gene Name: SprT-like N-terminal domain
  Uniprot ID: Q9H040
  ENST ID: ENST00000008440
  CDS Start-End: 129-752
gacgggccgtctcgagagccggcatctcctaggagctagtcctggtcctcggctaggcggcttggggtcgcggcgtaactggggagccagcctgacgccggcggaccccgcctgtgatcctggcaacgatggatgatgacttgatgttggcactgcggcttcaggaggagtggaacttgcaggaggcggagcgcgatcatgcccaggagtccctgtcgctagtggacgcgtcgtgggagttggtggaccccacaccggacttgcaggcactgtttgttcagtttaacgaccaattcttctggggccagctggaggccgtcgaggtgaagtggagcgtgcgaatgaccctgtgtgctgggatatgcagctatgaagggaagggtggaatgtgttccatccgtctcagcgaaccccttttgaagttgaggccaagaaaggatcttgtagaggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactcaaaaaaaggcaaaggaaaggcaaaactaggaaaggaaccagtattggccgcagagaataaaggtaccttcgtgtatattcttctgatttttatgtgaccatagctatgatgtaaagacaatactgtccttcagagaactggtattaagataaacttaaggatcgtttctggtgtagaagtcttcaagtgtagacttaaggaaaaaatcccactgtccatgaaatgatggtaggaaaacagactttgctctgtacagaagtaagtaaaagtaggaatagtttccatggatatttttatttttattaacttttttcagtttctttttattcaaagaaacaaaattcaatctctgataatatttgaggtaaagttcctttccctatcttgactcactgagttattaggaaacagaaggcaaaaagattgtcaaaataaaaacaataattcaagtaacaatgcccggaatatacgtcctaactacaccccttcctatcagctggattctatccaagtgactctattgatgtatgtatgttcattcaaagaatgggaaaaggatatgacatatatttgccagtacttcatcttcaagatttacccttttcctgtgaagttcagagttactgaagatgcttcttcccttgggaagttgttgacccaagaacataggttatatttcccaaatctttaattattgagtgaaagagctatagatgaattgatatggaaagaccgtatcttcattttcgtgagtagaaggaaagataagaatgaggcagcagattttccctcctggaattacacataaaggacactaagcaattttcaaggtaaatgttgccttgttgttggtctttggcatgataagattctttatttaaatatgagagaatttttttttatcctttatattctctcaatatcagaactcctgaattctgaagattgccctcctcccattaataggattgtatggatgtaagatggaataaaatactagttcttcattttg

SEQ ID NO: 186168 - DNA, 3468 bp, Homo sapiens
  Payload ID: 16660
  Gene Symbol: SPRTN
  Gene Name: SprT-like N-terminal domain
  Uniprot ID: Q9H040
  ENST ID: ENST00000295050
  CDS Start-End: 337-1806
tgaggtttgaaataaccggcaaagagtaaaggctgaaactagcttcctgaaagcttcgtagggcccgagccctgtgagcccaggttctgcgcccactaggaggtgtcatgctgactgctttttttaaagccctagaatcttggcttcggcgtttggggtaagctccgttctcgttctcaagcgcgtttccgcgaactctcgcgggattgacgggccgtctcgagagccggcatctcctaggagctagtcctggtcctcggctaggcggcttggggtcgcggcgtaactggggagccagcctgacgccggcggaccccgcctgtgatcctggcaacgatggatgatgacttgatgttggcactgcggcttcaggaggagtggaacttgcaggaggcggagcgcgatcatgcccaggagtccctgtcgctagtggacgcgtcgtgggagttggtggaccccacaccggacttgcaggcactgtttgttcagtttaacgaccaattcttctggggccagctggaggccgtcgaggtgaagtggagcgtgcgaatgaccctgtgtgctgggatatgcagctatgaagggaagggtggaatgtgttccatccgtctcagcgaaccccttttgaagttgaggccaagaaaggatcttgtagagaccctcctgcatgaaatgatacatgcctatttatttgtcactaataacgacaaagaccgagaagggcatggtccagaattttgtaaacatatgcatcgcatcaacagcctgactggagccaatataacggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactcaaaaaaaggcaaaggaaaggcaaaactaggaaaggaaccagtattggccgcagagaataaagataaacccaacagaggtgaggcccagctagtaatcccttttagtgggaaaggatatgttctaggagaaacaagcaatttaccttcacctgggaaactgatcacttcacatgccattaataaaacccaagatcttttaaatcaaaaccattcagcaaatgctgtaagacctaattctaaaatcaaggtgaaatttgaacagaatggttcaagtaaaaattctcatctggtctcccctgctgttagtaacagtcaccaaaatgttctaagcaactactttcctagagtatcatttgccaaccaaaaggctttcagaggtgtgaatggatctccaaggataagtgtaacagttggcaacatccctaaaaactcagtctcttctagttctcagagaagggtttcatcttctaagatatccctaagaaattcttcaaaagtaacggaatcagcatctgtgatgccatcccaggatgtgagtgggtctgaagatacattcccaaataaacgacctaggctagaagataagactgtttttgacaatttttttatcaagaaagagcaaataaaaagcagtggtaatgatccaaagtatagtacaaccacagctcagaattccagcagttcatccagtcagagcaaaatggttaattgcccagtttgtcagaatgaagttctggagtctcagattaatgagcacttggactggtgccttgaaggtgacagcatcaaagtcaaaagcgaagaaagtctttgaaaaaggtttcaaagtctcaagtaccacctgtattatctcactaatgtgctatgtcagccagtcaggaagttctggttaatactaagatttgtaggttataatctagttcacataaccaatagaaagtgtcctattttatatatacgcatataagattgtaattttaagatgttttgtgtctcagggtgctacattcactcttgccttaggtatactgtaacccaggttctgcctgtcgtgtataagttttagatacttttgttctttcttgctcttaaggattttaaaaacctgttaatctttttatttgtatactttcctaaaaatattcatatggggaatcctgtcaggtgtttggttatattgactatttattaatagtattagaactcattccctgaactgatgtaaatcttcatagtgtcagacatactgaccaaaaccacaatctagactacaaagtatattgttttagagtactcaaattgtattatttattaatttttttgtttgcaaaatcttaacaggaactgtattttctatattttaaagaattttatttgtcccacttttactaaacagtggcagcagattttaagttaaagaatatggaatatagtaaaataagtaaatttcttttggaatatttttagtaacaaatagccactataattctgtaggccaaattttatattgagtttagctgttttctcaaaatttagcagagtggttaaaattctgtgctgataagtaactgatacatataacataaacataacaaagttgcctagttgatgtaacagtggaaagttatctggaaatagtattttgaactttaagccaagtttaaaacattataataaaaggaataccatttgtgcattttaagtaatcttttttaaaaaaaatattttccatgttatagggaaaggacaaagagacttttatcagtttgctttttgtcttgtggctgtacatgctgttggcatagccctaacacagttgttcacaagttttcttttttcttgttgcaattttccttcactttgttgtaatacaggtgcacaaatcttaagtgcacagctgggtaaacttttacagtgttcacctgtgtaactaccacccggatcaagttagagaacacttccattgccacagaaggcttcctataggtgtctgttcccagttgatacccatgaccctcaccacctccagaggtccccactgttttcaccccatcgtcgcagattattttttaattttataatgtagtatctttgttcctatgtatagcaggagttcattttcattgctcttgcatttgtatgaatatactagaatttattcatccattctaatgttaatggacatttgaattatttccagtttggggctgttaagcataatgctgctaagaacattcttatcttttctgttgggtatatatacaggaatggaattgctgagtcacggggtatatttctgtttagctttagtaaattctgccagtttacactcctaccagcaatgtatgagagttttagttgttcaccattcataacactgttagcagcccttttcgttttagactggttggctgttcacaaattttgatattccttaaagcattaaaacattttaataaatacttataaataggta

SEQ ID NO: 186169 - DNA, 795 bp, Homo sapiens
  Payload ID: 16660
  Gene Symbol: SPRTN
  Gene Name: SprT-like N-terminal domain
  ENST ID: ENST00000366644
  CDS Start-End: 235-795
ttgggccatgtggtccgcatcgtattccactaggtccccgttgtacaccaggtgtgctgggatatgcagctatgaagggaagggtggaatgtgttccatccgtctcagcgaaccccttttgaagttgaggccaagaaaggatcttgtagagcataattttataagactaaaattcattaatgacagtctagttcttctgatggaaattgttttttaaaaaaattatggaggatcatgaaaaagaccctcctgcatgaaatgatacatgcctatttatttgtcactaataacgacaaagaccgagaagggcatggtccagaattttgtaaacatatgcatcgcatcaacagcctgactggagccaatataacggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactcaaaaaaaggcaaaggaaaggcaaaactaggaaaggaaccagtattggccgcagagaataaagataaacccaacagaggtgaggcccagctagtaatcccttttagtgggaaaggatatgttctaggagaaacaagcaatttaccttcacctgggaaactgatcacttcacatgccattaataaaacccaagatcttttaaatcaaaaccattcagca

SEQ ID NO: 186170 - DNA, 3559 bp, Homo sapiens
  Payload ID: 16660
  Gene Symbol: SPRTN
  Gene Name: SprT-like N-terminal domain
  Uniprot ID: Q9H040
  ENST ID: ENST00000391858
  CDS Start-End: 1281-2033
caccaacaagcaatcgttcatgagaaagccgtgcacccgctgcagttgggccatgtggtccgcatcgtattccactaggtccccattgtacaccaagtactgtcccggcgtctccagcagatgcctgcagccttccaccttctcaagcagggtggtgagagtgcgctgctttccttcctcgcctggaccggagccgtcgcgggaggcacccccgggggtggagaaaaagccggcctggcctcggaggtggtctcggccccccgccccaccgactccctcctcccctccagaggcggcggcggctccggcggcagcagcggcaggcagcaacgtaagcgggatgctctccaggctgcttttctgctcggtcagcaaatggctgagctggtacatctcgctctccaggtaggagatctcgcgggccgtctctatgaactgccggtagttctggtagacgttgcgcttcaggttctgcgccgtctcctccgccagcgcctggatgcgctgccggtgctcctggaggtcccggtccccatccgactgctgcgagagctgcttcacgtacagccgcgcctcaaaaccccctgactccagctgccgacgcaggcggctcgccccactgtccgacatcgccatcgccatttctctccgggtctcacgcactcactgtcactatcggcgccgcagccgccgcggctgtctagacccacccaaggccaaccgagctcctgggctgaggaagcaggaatgggaacgagacgagtacgcctgcgccgggtctgagcgtcagacactgcgcctgcgcaagtgggccgagcgcagacattgcgcctgcgcagcaatgccatcggttaaagcgcatgcgcaagatgagctattgcggaagtgaggggagggagaggccgagagaaatttcggtactgcgcatgaaccgagcgtgacgttgaggtttgaaataaccggcaaagagtaaaggctgaaactagcttcctgaaagcttcgtagggcccgagccctgtgagcccaggttctgcgcccactaggaggtgtcatgctgactgctttttttaaagccctagaatcttggcttcggcgtttggggtaagctccgttctcgttctcaagcgcgtttccgcgaactctcgcgggattgacgggccgtctcgagagccggcatctcctaggagctagtcctggtcctcggctaggcggcttggggtcgcggcgtaactggggagccagcctgacgccggcggaccccgcctgtgatcctggcaacgatggatgatgacttgatgttggcactgcggcttcaggaggagtggaacttgcaggaggcggagcgcgatcatgcccaggagtccctgtcgctagtggacgcgtcgtgggagttggtggaccccacaccggacttgcaggcactgtttgttcagtttaacgaccaattcttctggggccagctggaggccgtcgaggtgaagtggagcgtgcgaatgaccctgtgtgctgggatatgcagctatgaagggaagggtggaatgtgttccatccgtctcagcgaaccccttttgaagttgaggccaagaaaggatcttgtagagaccctcctgcatgaaatgatacatgcctatttatttgtcactaataacgacaaagaccgagaagggcatggtccagaattttgtaaacatatgcatcgcatcaacagcctgactggagccaatataacggtataccatacttttcacgatgaggtggatgagtatcggcgacactggtggcgctgcaatgggccgtgccagcacaggccaccgtattacggctatgtcaaacgagctactaacagggaaccctctgctcatgactattggtgggctgagcaccagaaaacctgtggaggcacttacataaaaatcaaggaaccagagaattactcaaaaaaaggcaaaggaaaggcaaaactaggaaaggaaccagtattggccgcagagaataaaggtaccttcgtgtatattcttctgatttttatgtgaccatagctatgatgtaaagacaatactgtccttcagagaactggtattaagataaacttaaggatcgtttctggtgtagaagtcttcaagtgtagacttaaggaaaaaatcccactgtccatgaaatgatggtaggaaaacagactttgctctgtacagaagtaagtaaaagtaggaatagtttccatggatatttttatttttattaacttttttcagtttctttttattcaaagaaacaaaattcaatctctgataatatttgaggtaaagttcctttccctatcttgactcactgagttattaggaaacagaaggcaaaaagattgtcaaaataaaaacaataattcaagtaacaatgcccggaatatacgtcctaactacaccccttcctatcagctggattctatccaagtgactctattgatgtatgtatgttcattcaaagaatgggaaaaggatatgacatatatttgccagtacttcatcttcaagatttacccttttcctgtgaagttcagagttactgaagatgcttcttcccttgggaagttgttgacccaagaacataggttatatttcccaaatctttaattattgagtgaaagagctatagatgaattgatatggaaagaccgtatcttcattttcgtgagtagaaggaaagataagaatgaggcagcagattttccctcctggaattacacataaaggacactaagcaattttcaaggtaaatgttgccttgttgttggtctttggcatgataagattctttatttaaatatgagagaatttttttttatcctttatattctctcaatatcagaactcctgaattctgaagattgccctcctcccattaataggattgtatggatgtaagatggaataaaatactagttcttcattttgagaaaactgtacattagtttaatgtttgttactgtatttcttttgagttgaggcacttacataacaatcttctttgcttttttggcagataaacccaacagaggtgaggcccagctagtaatcccttttagtgggaaaggatatgttctaggagaaacaagcaatttaccttcacctgggaaactgatcacttcacatgccattaataaaacccaagatcttttaaatcaaaaccattcagcaaatgctgtaagacctaattctaaaatcaaggtgaaatttgaacagaatggttcaagtaaaaattctcatctggtctcccctgctgttagtaacagtcaccaaaatgttctaagcaactactttcctagagtatcatttgccaaccaaaaggctttcagaggtgtgaatggatctccaaggataagtgtaacagttggcaacatccctaaaaactcagtctcttctagttctcagagaagggtttcatcttctaagatatccctaagaaattcttcaaaagtaacggaatcagcatctgtgatgccatcccaggatgtgagtgggtctgaagatacattcccaaataaacgacctaggctagaagataa

SEQ ID NO: 186171 - DNA, 2932 bp, Homo sapiens
  Payload ID: 16661
  Gene Symbol: SPRYD3
  Gene Name: SPRY domain containing 3
  Uniprot ID: Q8NCJ5
  ENST ID: ENST00000301463
  CDS Start-End: 88-1416
cctctaggagtgaaggaaaggcggggacccggatgtgtgtggtggcggcggccgaagagcttgtgtgcggagctgagaggcctatggatgaggaggacgcggcggccccggtttgttctcatgaacaagatggatgacctcaacctgcactaccggtttctgaattggcgccggcggatccgggagattcgagaggtccgagctttccgatatcaggagaggttcaaacatatccttgtagatggagatactttaagttatcatggaaactctggtgaagttggctgctacgtggcttctcgacccctgaccaaggacagcaattattttgaggtgtctattgtggacagtggagtccggggcaccattgctgtggggctggtccctcagtactacagcttggatcaccagcctggctggttgcctgactctgtagcctaccatgctgatgatggcaagctgtacaatggccgagccaagggccgccagtttgggtcaaagtgcaactccggggaccggattggctgtggcattgagcctgtgtcctttgatgtgcagaccgcccagatcttcttcaccaaaaatgggaagcgggtgggctctaccatcatgcccatgtccccagatggactgttcccagcagtgggcatgcactccctgggtgaggaggtgcggctgcacctcaacgctgagctgggccgtgaggacgacagcgtcatgatggtggacagttacgaggatgaatggggccggctacatgatgtcagagtctgtgggactctgctggagtacttagggaagggcaaaagcatcgtggatgtggggctggcccaggcccggcacccactcagcacccgcagccactacttcgaggtggagatcgtggaccctggagagaaatgctacatcgccctggggctggcacggaaggactatcccaagaacaggcaccctggctggagcagagggtctgtggcttatcatgcagacgatgggaagatcttccatggcagtggtgtgggggacccctttgggccacgctgttacaaaggggacatcatgggctgtggaatcatgttcccccgggactacattttggacagtgagggggacagtgatgacagttgtgacacagtgatcctgtctccgactgcccgggccgtccggaacgtgcggaatgtcatgtacctgcaccaggaaggggaagaggaagaggaggaagaggaagaggaagaggatggggaagagatagagccggagcatgagggcaggaaggtggtggttttcttcactcggaatggcaagatcattgggaagaaggatgctgttgttccttctggaggcttcttccccaccattggaatgctgagctgcggggagaaagtcaaagtagatctgcaccccttgagtggctagggcctcccctccagacctgctccttctccctgctcaccctctgctgggccaggcacccagttcctgacttcccagaggcttcgtttacccagcaggcccctggaggtgtgtagtcactctgcccccactggctcaggcccctgtcacgcttctctgtgcccacgtttctgacctggtgctgccactgttgtcagtccctgggcctgagtccctggttggacaggaatggacccaaagaatggtgttggtatgtgggtggtcccactcgctttggtcagtgggcttctgggtccccctttccctcaccggccctgtgtgggtggagaggcgtgagcaccctatctcagctgctattcgggcatgatgctttgtagagggtagagtagacagccccctcccctactcaccatggtatttctccttgaattcctctttcttgttttctttcctggttgtgtgaaccagttgctgctgtcatacccctggcagggccaggggacctctctttggtcatctctgtcctttcactggctgctgccccaggaagactcctctaggctctccatctttcccttgagagctggctccccaccccaacctgctcaggcaccacagaggatctaggtctctggctccccatacctggacccacatgggtgggtgcctgttgcatgtttaagagagaggggctgtgaggtgacagggcactagggccttcactcctttctccccttccatcctttctttaccagtgccacccatgtccctagctcccgggtattggggctgaggctctggggcctgtctccctgccagcgtgagggcaagaccccagagccttagctgagcaagcccagaggggcagcgtggcccctccctccccttttcctgccccgtcccatgcctcagcttgctgcttgtgccagttgcctgtttcgcttcagtgtttgattctagcacttacatgtgtcctccccaccaagccctctatctccttctaatccttcaacccctggccccctccccgtaacagtgacttttccagggaggaagaggcagcaggagctgttggccttggtttgcacagagcgggtagggctgtagggaaagcgggtgagctgttgtgctgctgggcctccctttggccctcgcttcccaccctacgatgtatgaaatgtatgtacagaccagagatgtttatacagccgataaagatggagtttccgtatttatcagtatggccggaaccaggagcctttctagtccactgggctaggaacaggactgctggatgggggcagccgaaggcagcttgctcatggggagatgtggaccaatgttgggccagggatgggaatcatatgttccatgggcctggctacaggcctgagcacagatacgtcccctgggagatgaggctttgaccttcctgtgaataagtgttgactccaatttcggctaaagtttatagaaattctttattattagacaaaaatagactctcttttttccccta

SEQ ID NO: 186172 - DNA, 927 bp, Homo sapiens
  Payload ID: 16661
  Gene Symbol: SPRYD3
  Gene Name: SPRY domain containing 3
  ENST ID: ENST00000537540
  CDS Start-End: 72-569
aaaggcggggacccggatgtgtgtggtggcggcggccgaagagcttgtgtgcggagctgagaggcctatggatgaggaggacgcggcggccccggtttgttctcatgaacaagatggatgacctcaacctgcactaccggtttctgaattggcgccggcggatccgggagattcgagaggtccgagctttccgatatcaggagaggttcaaacatatccttgtagatggagatactttaagttatcatggaaactctggtgaagttggctgctacgtggcttctcgacccctgaccaaggacagcaattattttgaggtgtctattgtggacagtggagtccggggcaccattgctgtggggctggtccctcagtactacagcttggatcaccagcctggctggttgcctgactctgtagcctaccatgctgatgatggcaagtgggctctaccatcatgcccatgtccccagatggactgttcccagcagtgggcatgcactccctgggtgaggaggtgcggctgcacctcaacgctgagctgggccgtgaggacgacagcgtcatgatggtggacagttacgaggatgaatggggccggctacatgatgtcagagtctgtgggactctgctggagtacttagggaagggcaaaagcatcgtggatgtggggctggcccaggcccggcacccactcagcacccgcagccactacttcgaggtggagatcgtggaccctggagagaaatgctacatcgccctggggctggcacggaaggactatcccaagaacaggcaccctggctggagcagagggtctgtggcttatcatgcagacgatgggaagatcttccatggcagtggtgtgggggacccctttgggccacgctgttacaaaggggacatcatgggctgtggaatcatgtt

SEQ ID NO: 186173 - DNA, 635 bp, Homo sapiens
  Payload ID: 16661
  Gene Symbol: SPRYD3
  Gene Name: SPRY domain containing 3
  ENST ID: ENST00000547257
  CDS Start-End: 1-181
ggatggggaagagatagagccggagcatgagggcaggaaggtggtggttttcttcactcggaatggcaagatcattgggaagaaggatgctgttgttccttctggaggcttcttccccaccattggaatgctgagctgcggggagaaagtcaaagtagatctgcaccccttgagtggctagggcctcccctccagacctgctccttctccctgctcaccctctgctgggccaggcacccagttcctgacttcccagaggcttcgtttacccagcaggcccctggaggtgtgtagtcactctgcccccactggctctccatctttcccttgagagctggctccccaccccaacctgctcaggcaccacagaggatctaggtctctggctccccatacctggacccacatgggtgggtgcctgttgcatgtttaagagagaggggctgtgaggtgacagggcactagggccttcactcctttctccccttccatcctttctttaccagtgccacccatgtccctagctcccgggtattggggctgaggctctggggcctgtctccctgccagcgtgagggcaagaccccagagccttagctgagcaagcccagaggggcagcgtggcccctccctcc

SEQ ID NO: 186174 - DNA, 1655 bp, Homo sapiens
  Payload ID: 16661
  Gene Symbol: SPRYD3
  Gene Name: SPRY domain containing 3
  ENST ID: ENST00000547837
  CDS Start-End: 45-1484
ggcggcggccgaagagcttgtgtgcggagctgagaggcctatggatgaggaggacgcggcggccccgggtcttgctctgtcagccaggctggaatgtagtggcacaatcagaactgactgcagccttgacctgccagactcaagccatcttcagtctccttagtagctgggactacaggtttgttctcatgaacaagatggatgacctcaacctgcactaccggtttctgaattggcgccggcggatccgggagattcgagaggtccgagctttccgatatcaggagaggttcaaacatatccttgtagatggagatactttaagttatcatggaaactctggtgaagttggctgctacgtggcttctcgacccctgaccaaggacagcaattattttgaggtgtctattgtggacagtggagtccggggcaccattgctgtggggctggtccctcagtactacagcttggatcaccagcctggctggttgcctgactctgtagcctaccatgctgatgatggcaagctgtacaatggccgagccaagggccgccagtttgggtcaaagtgcaactccggggaccggattggctgtggcattgagcctgtgtcctttgatgtgcagaccgcccagatcttcttcaccaaaaatgggaagcgggtgggctctaccatcatgcccatgtccccagatggactgttcccagcagtgggcatgcactccctgggtgaggaggtgcggctgcacctcaacgctgagctgggccgtgaggacgacagcgtcatgatggtggacagttacgaggatgaatggggccggctacatgatgtcagagtctgtgggactctgctggagtacttagggaagggcaaaagcatcgtggatgtggggctggcccaggcccggcacccactcagcacccgcagccactacttcgaggtggagatcgtggaccctggagagaaatgctacatcgccctggggctggcacggaaggactatcccaagaacaggcaccctggctggagcagagggtctgtggcttatcatgcagacgatgggaagatcttccatggcagtggtgtgggggacccctttgggccacgctgttacaaaggggacatcatgggctgtggaatcatgttcccccgggactacattttggacagtgagggggacagtgatgacagttgtgacacagtgatcctgtctccgactgcccgggccgtccggaacgtgcggaatgtcatgtacctgcaccaggaaggggaagaggaagaggaggaagaggaagaggaagaggatggggaagagatagagccggagcatgagggcaggaaggtggtggttttcttcactcggaatggcaagatcattgggaagaaggatgctgttgttccttctggaggcttcttccccaccattggaatgctgagctgcggggagaaagtcaaagtagatctgcaccccttgagtggctagggcctcccctccagacctgctccttctccctgctcaccctctgctgggccaggcacccagttcctgacttcccagaggcttcgtttacccagcaggcccctggaggtgtgtagtcactctgcccccactggctcaggcccctgtcacgcttctctgtgcccacgtttctga

SEQ ID NO: 186175 - DNA, 10779 bp, Homo sapiens
  Payload ID: 16662
  Gene Symbol: SPRYD4
  Gene Name: SPRY domain containing 4
  Uniprot ID: Q8WW59
  ENST ID: ENST00000338146
  CDS Start-End: 26-649
gtgcccggttcatccaaggcgcaagatggcgctgctttttgcacgttctttgcgcttgtgccgctggggagccaaacgattgggagttgcctccacagaggcccagagaggcgtcagtttcaaactggaagaaaaaaccgcccacagcagcctggcactcttcagagatgatacgggtgtcaaatatggcttggtgggattggagcccaccaaggtggccttgaatgtggagcgcttccgggagtgggcagtggtgctggcagacacagcggtcaccagtggcagacactactgggaagtgacagtgaagcgctcccagcagttccggataggagtggcagatgtggacatgtcccgggatagctgcattggtgttgatgatcgttcctgggtgttcacctatgcccagcgcaagtggtacaccatgttggccaacgagaaagccccagttgagggtattgggcagccagagaaggtggggctgttgctggagtatgaggcccagaagctgagcctggtggatgtgagccaggtctctgtggttcacacgctacagacagatttccggggtccagtggtgcctgcctttgctctctgggatggggagctgctgacccattcagggcttgaggtgcccgagggcctctagtatgtccattactggagtccctaatcacgcctttggccagcctccttttgaaagtgtccgaagcctttttactttgcctcaagcaacctctagctcccacaattcagtgttgggtcctctgtgcaatatcatgatcatcttcctcatcccctaccttgtgaaagctaggcatacagccaaaccctccttttccccacccaccaactactgccaatttcctaggctaccatgggtgtatcttccttgacctgcttccttcagtccctctgcctccctttgcccaggcctttctcagactgtattccatcctggggtcttatcattcagctttgtttgaatttattaatcaccatgatacctctccctccctttgtccacatgtaacttgttcttggggctctaccagatggctgaagagtaaatcctttctacctctggctgaaggagtggtgcagtcaatgacttggccctttttctacagcacatttagagtttgggctctggctccctcagtaagtgctttattaactcagtgtgtcaaaatgaaaacagagccctccttccccagtagctcagtgccacagaccttcagccccacacagctgtagctatccttaccctgagtccatctaccttaaatctgtacctctgacacccagccagtctgtcataatcattatcccagttataaccttgaccaaaggggaagagagacacttgggggatatctaggggatgagtgctagaaactatttatttatttttgagacagagtctcactctgtcacccaggctggagtgcagtggcatgatcttggctcactgcaaactctgccttttgggttcaagcgactctcgtgcctcagcctcctgagtagctaggattacaggtgtgtgccaccatgcccgtctcatttttatatttttagtagagatggggttttgccatattggccaggctggtctcgaactcctggcctcatgtgatcagcccaccttggcctcccaaagtgctgggatttcaggcgtgagccaccacacccggccaaaactgtttattcttgagaagttccatcttcatttctgccacagttggaacttcccgaggaaggaaggaggcctgaggttttgcacaatctgtttcagagcctgtttagactcaaacctatgcttcccttggcagcagaatacacttaacctaaagcagtatttggagttgagaaaaacctggtggggtaagtgaatatgtactgtttggtagggtaggtagagaagctgtgctttgaccctgtgattccatctttttctaccttctatgatggtgatgaagctagatacccctagggaagaaagaaggactgggtttagcaaaaatgatttggtaattaaagtttatttgaacacaaaatactttctctgtctataaaattggctgttagcagtagcagcagcatgtcctggccaaggggagtagatttctccagactactaaagccatgtatatagccattcccacttcccatattctgtggatatgtacatgtgcatggtagctagagtccctccaccagagtatctctctcatgatggtttcttcagggagaggaagaggagacctgggtgaagagctgggatggttttgagtggggcaagccattaggctgtaccttgaagcccagtctctctggatagctgtactgcaggtgtcctctgaggcccttctctgtactctgtctgctgagggaatggggtattttgactcccatagaaagcactagcctaagtcaccaaatgactgcttggtccccactgaagcagtgtagctctccatagtatttttggtggttatggattacatgtgtggccagctcatgctttttcttgagcaggggctgtccatgacctgtgctcataccatgctttctaagttctctttggacagggcctcagctgctgcctcagcctgagtttcagagagtgtgtaggagtcctggtaatcttgaagcagtttgaccacctccagatggttgaactgcacagcatcatccaggggaatgttgccccacctgagaggaataatgatatgatcaggcaaaggagacgtggagagtggtggttgtatatatttgcatggtggctggagggtaggtggagaagctgtgcccaccctcctccacttttagcctattcctcacctgtccttggcaaaaggattcactttgcaagcctcgatcaggaatttaacaacttcgatgtgtcctaggaatatgggcagaaggaaaatgagaaggcgcaggtcttgaaccctttggtgcagacacttagccactgaagtctttaccaagaggggaggggaaaaggcctcttcccattttgtaccctgcagcactcagtcatagtctagctgcaaaccgaagggtgtctagataaaactagttgctgcccctataaccttgagggcacatataatgaaggtacttttggtgaaaaagaaagggtcttatgattaccctcctcctcccctccttaacccttcagtaccttcagctgcagcaacatgcagagctgtgcgcgagtcatagtctttctgttccatatccatggctgacaaggcaaacctgagggtagtgggaaagcagctagagttgcctagatcagactggaatcacaggtgttctttgtgaactggtgtcagactggatgagtttcagagaaagtgaaacagcctatagccagatttgttggctctgaataatcttttttccatatccagatgagactgttatactcatattagagagatgggaatgtgatccttccagaaatatcactcactgcctacctgtggtaagtgcccatttgaggcagggtacctacttcctaggacactgctcttaacactcaataacaatggctaacattaattatcatagagcagacagtttactttttttaaaaaaaatctccttttttaaaaaaatttcatttaaatgcaatctatatccattctaattccaaagctgaagcacttaactattttgttacgctgcctcctagtaaaatctctgaccaggagtattttattgtgtatatttggtcacagtagcattaccttcgaagagctgagacatcgccactataggcagcaaataacaggttgaccacagtcttgttctggaacacaaatcatacccacatgacattaattgaactcacctatgccagctgtgccctgtgaccctcctccatggatgcttagtccaagggtattgctgaagtgttatggaatgtgctactctgaaatattcttttttttttttttttttttgagacggagtctcgctctgtcgttcaggctgaagtgtagtggcgcgcggtcttggctcactgcaacctctgcctcccggtttcaagcgattctcctgcctcagcctcccaagtagctgggaccacaggcgcgtgccaccacgtctggctaattttttgtattttcaatagagaccaggtttcaccgtgttagccaggatggtcttgatctcctgaccttgtgatccgcccgccttggcctctcaaagtgcagggattacaggcgtgagccaccgcacctggcctttgaaatattcttacaagccacctggagttttccttacccgaatttctgccccttcacgccgtgggtctaacttccgagcacagtgcctcaggttgtcatagttgtggaaattgaagagagacaccaacttctagaattgtaagccaaatatattgtttatttactccttacacttagtaggagctcaaaattgctttattatagtaaaagtggtaccattaaacaaatttattgcttcaaaaatagtaagtactatatgcaaagcatctcacctggcagaagctggtccccctatggctgttccccagcttgtccaatgggggtgacaggcacatcattcccatgacattgggtaccaccaggaggatggctcctgatacagctgacttggctggcaggcccacctggggaacagaactgaagctgaggataaagtgggtgtgccccaaatcagaaaataaacaagttaggctgtactcttaacaagtttacaaatgactgcatgaccacaatccacctcaaccttttggcttgttaattagcttcttttattactcctgtcctttccttcccttaaattcattgattcagctagaaaatattttttgaaatacttacagcattctgtgctagatgctgtgctagaactaggaacttccattctggtgttaggagataggtaataaacaggtaaataaatagacacgtaatgtttaaagtaattgtgataaatagtgagaagtagggtgctgtaaatagaggtagaggggggccacatgagatagggtggtcagaaaagtctttctttggaaatgacatctaagctgagaccccaaggagaagagccagcaatgtgaagcacaattcaggagctgcaacacctctggttgtttttctttttctttttttctttttttttgagatggagttttgctcttgttgcccaggctacagtgcaatggcacaatctcggctcagtgcaacctctgcctcccaggttcaagcacttctgcctcagcctcccaagtagctgggattacaggtgcacaccaccacccccggctaattttttgtatttagtagagatggggtttcaccatgtaggtcaggctggtctcgaactcctgacctcaggtgatccacctgcctcggcctcccaaagacatctctttatatattcgaggaacttggtgtttttgagaaactcgtctaaggagtctcaacctaattgccttcctggaagttagtgaatgagaggcaggaacaagcttccacctctatcttgagagagtcagtgttctctcttcttagcactgggctcatgacagatggatagcagagccagaaactcacgtggaaggcaaactggccagagaagtcatacatgccgcaggaatgcatgaggctgagggtgttgcgcactgcttcagcactcagcacactctcgcctgtgatggggcagatcccaccgttggcgagggtggctgccatgacactgcctgattcacaagtgacctccacagaacacagctatgaaaacaaagaataggtgaagatgtgacgtgaacctgcacatgggaccctcgggtgtagggaaagggcaagggcaaggacagtctgtcctgttccctcggccctgagcagtgttttcttacctggaagtagagatcaagggcagccatcatgtccacccccttaggaaagcactgcaaggaagagaggggagagcatttctcttcaggacatcagccctttcacactgtcagggtctcagctgaagcccccaacccctactgcccttccactagcagcagaattcccagggactttctcttccggcctcttctggttaccttcttttccttgagataatagccgatggcataattccgatcccctgtttccttctctgactggaatctgaagcaaacacccaatttagtacttgaagttggaggagtgggtgttgggagaaggggaaaaattaccttccctggagagacagaactacatcacaccacaaactaaatgaacccctttataacttctcacagtaatattagaggaaatttctgaacctgagcaaacactcagcatagttttgttataaagtaaacccaaaccaaacaccccaaactgtctagtcatctaggaaaactggtgaagtttttggctttgaaagtcttggcaagaaagggcttaggcacaaaccatcacactgcctctctcattatgtactaattagaaatggaacaaattattttacaagataaacaaatgtttatgaagggactcagaggaagctggagggccaaagttcccctgggatttcttcctcctaagattctctctcccccattcctcttgtccccatcctaagtacacacacatacaccacaatgctttcagtcagtcctctgagtagggacttacgtggcattgctgaaacccatgtattcattcccagccattttgttgagatactgcaacacctggaagagaaaaagggacattgaggctccacttggttaagaagctctattaatacctcacaggttgactagcccttctgaactcaggtcttgtcaagaggctttcctctctgaggccagcagatttccacatttctggaaataaggcttctagtatgggctggtgcacctggtagtggggttagagagccactggggcagctggagaggacagcatgccatggcgaaatgcagccaggggctaagtagcaagggaacttacaaaatcaaacttctctgctttgttacagtccatctgcagagaaagagagagatgtcagcattctaagtgtaggaggatgacagagggaagggtcagaaggatctagtggagttctagtgttagtctggtcctgctgctgcaaatgtgttcaattttataatggccctttttttatccttctgaaaacaccgcacttccattggctcctctctttctctttcttttttttgagacagtcttgctttgtcacccttgtcacccaggctggagtgcagtggcacgatcatggctcactgcagctttgacctcccaggctcaagcgatcctcccacttcagcctccaagtagctcggattacaggcatgagccagcttgctgggccatcccacttccattctcaatccaaaccctcatccctgactcccacgttcattttcctgactcgaatcctgtctcctagccccaccctatccctgatctccatccccattccttacaccccatgctggagctttactccatcccattggccagcatgatggttcatgcctgtaatctcagcaatttggggggctgaggcaggaggatcgcttgagaccaggggtttgagaccagcctaggcaacataggagagaccctgcctcaatttttttttttttttttttttgagatggagtcttgctctgtcgcccaggctggagtgcagtggcaggatctcggctcaactgcaagctccgcctcccgggttcataccattctcctgccttagcctcccgagcagctgggaccacaggtgcccaccaccaagcctggctaattttttgtatttttagtagagacggggtttcaccgtgctagccaggatggtctcgatctcctgacctcgtgatttgcccacctcggcctcccaaagtgttgggattacaggcgtgagccaccgcgcctggcctctatattttttaaaaaaggtcctacttagatgggaatgggatgaggcaggtcccagatacaggtttgtagatggagccatcacagaacaaggggagagactcagcctcttttcctcacccagactcattgcttactcatgtgtcaactacagagtcaataccacagggactctgatacctgagtccctgaggggaggattcctaacaccaccttccccaggaggggctgtgattggctccagggtgttgctgcccagctgctcccaggttcttgctcaagccctgggagacctacagctgatgggctagtctgacaccctgttcaaggccaactcacagttccaggtgacgtgaataactgccctggcctggccattcacccttgcctgcaggtgtcccacacccagaagtggccaatcagtgcccaatagtgctgtcctccccttgtctctggcatttggcccttggtcctaggcaggggtcaggacctgctcacttctctaagggtcagaaagctctaggctctagactcatgggtgggggcagggaacagtactgagtggggatgacggaggtggtgcagtctcttatactgacattgtcagcataacatgtgggtccctgctgtgcctcatgtgccttctggggaccctcaaaggaatcagagccccaccagtctccctggagagctgaacaaatatgagggatacaggaacacaggagcttagaggataatacctatcagaaggttaaggtggcactgaccttgatcagggagctgacaacaatggcaccagcattgaccatggggttatgggggattcctggggaaatacaaaccaccaagagtcttagccactgaacaaagcctccctgacagcccgctcactttgtgggttagacaagaaagactgctagggagaaaggcatgacagggctaatcaggaagggcagagaaacaaaaaaggctgggagatggggtggggataaggagaaggggacagctgtaagtacggtctgagccttggtagtgctcaccttcctcattgagggagagcttgttgtagcgcaggccacttggctctttgcccacaaacttgtgcacgtagtcagtgcctagggtgcttatggagatggcataggtgaggggcttcacacaggactgcaggcagaaggggatctttgtgtggcccacagagtgcctggaggcagacagatgccatgaaaggggttggcctgtgttcggcacctgtgccctgcctccccttcctcttgcccagcatctcaccgttgaccatccacagtgcacagggagacaccccacaggtctgggtttgacttggccagctgagggatgtaggctgccacctggacatgagtgggtagagaaaagggagatggatgtggagaagaggaacagagttgaggttgagggtcaagagaatcttttagataaaagctaaaattctgtcttctatagggcagaggggttccctcctgcctgttgctcccagaaatgcccgagccttaagtcctagaaggccatatctttgtgtatccgcaatcctgtagagatagcagtaaagccaatggaagttaaaaaaggagaattctgaggcaaccttccccttttggttcttaggctcagttaccctataaatccctttgaaggctctattcgatcttgattccctcacctgctctaggaatcgtgtatagaaacacatgaagccatgtcaccatttacagaagttctgcttctcatctctcattcataggactcccagccccaggaaatctctgagaagcgaggtatatctaggtgtggtggctcatgcctgtaatcccagcactttgggaggccgaggtgggtggatcacttgagatcaggagttcgagaccagcctggccaatatggcaaaaccccatctctactaaaaatacaaaaattagtcgggcatggtggtgtatgccagctactcgggaggctgagacaggagaatcgcttgaacctgggaggtggaggttgcagtgagctgagattgcaccattgcactccagcccgggtgacagagcaaaactctgtctcaggaaaaaaaaaaaaaaaaaaaatctggcccaggtccctgacccctcccttagtcccctgactctcactttgcctccagtgagctctttgacatcctcaaagatgcgatccacatggcccgtgaactcctcaaaatcaggaatgacaaacttctttcggaatgcctgggtcaggagcacaatgttgctgctcacacacctggatcccagacacgattggattagggggctagagaaatgcagctgggactcactctggagccacggaaattgggaataaagaaggttgagtggtcttcaggtttgggatcaacagctctgttacctttggcaaatcagtttacctttctaggtcttagtttccgtacctctaaaatgaggggttttaatgatgtggaaagacactatgtcttgggatatgagaaaaaaaataaataccagaataatatgtatgtatgttaccttgatatttaaaaaatcctaaatcataaaagtatatttatatatattcatgtatgtatgtcagtacataggacattatctagaagatacccactaatctgctaatatttacttctgggaaaagaggacagggattgagtagggagggaaaggagaacatgtatttctatattgtttgaactcttatgatgagtattcatgtataacttatgtaataagtaataaaataaaatgaggaattgaactatacaattcccaaattc

SEQ ID NO: 186176 - DNA, 1994 bp, Homo sapiens
  Payload ID: 16662
  Gene Symbol: SPRYD4
  Gene Name: SPRY domain containing 4
  ENST ID: ENST00000629545
  CDS Start-End: 823-1200
ttgtgccgctggggagccaaacgattgggagttgcctccacagaggcccagagaggcgtcagtttcaaactggaagaaaaaaccgcccacagcagcctggcactcttcagagatgatacgggtgtcaaatatggcttggtgggattggagcccaccaaggtggccttgaatgtggagcgcttccgggagtgggcagtggtgctggcagacacagcggtcaccagtggcagacactactgggaagtgacagtgaagcgctcccagcagttccggataggagtggcagatgtggacatgtcccgggatagctgcattggtgttgatgatcgttcctgggtgttcacctatgcccagcgcaagtggtacaccatgttggccaacgagaaagccccagttgagggtattgggcagccagagaaggtggggctgttgctggagtatgaggcccagaagctgagcctggtggatgtgagccaggtctctgtggttcacacgctacagacagatttccggggtccagtggtgcctgcctttgctctctgggatggggagctgctgacccattcagggcttgaggtgcccgagggcctctagtatgtccattactggagtccctaatcacgcctttggccagcctccttttgaaagtgtccgaagcctttttactttgcctcaagcaacctctagctcccacaattcagtgttgggtcctctgtgcaatatcatgatcatcttcctcatcccctaccttgtgaaagctaggcatacagccaaaccctccttttccccacccaccaactactgccaatttcctaggctaccatgggtgtatcttccttgacctgcttccttcagtccctctgcctccctttgcccaggcctttctcagactgtattccatcctggggtcttatcattcagctttgtttgaatttattacaccatgatacctctccctccctttgtccacatgtaacttgttcttggggctctaccagatggctgaagagtaaatcctttctacctctggctgaaggagtggtgcagtcaatgacttggccctttttctacagcacatttagagtttgggctctggctccctcagtaagtgctttattaactcagtgtgtcaaaatgaaaacagagccctccttccccagtagctcagtgccacagaccttcagccccacacagctgtagctatccttaccctgagtccatctaccttaaatctgtacctctgacacccagccagtctgtcataatcattatcccagttataaccttgaccaaaggggaagagagacacttgggggatatctaggggatgagtgctagaaactatttatttatttttgagacagagtctcactctgtcacccaggctggagtgcagtggcatgatcttggctcactgcaaactctgccttttgggttcaagcgactctcgtgcctcagcctcctgagtagctaggattacaggtgtgtgccaccatgcccgtctcatttttatatttttagtagagatggggttttgccatattggccaggctggtctcgaactcctggcctcatgtgatcagcccaccttggcctcccaaagtgctgggatttcaggcgtgagccaccacacccggccaaaactgtttattcttgagaagttccatcttcatttctgccacagttggaacttcccgaggaaggaaggaggcctgaggttttgcacaatctgtttcagagcctgtttagactcaaacctatgcttcccttggcagcagaatacacttaacctaaagcagtatttggagttgagaaaaacctggtggggtaagtgaatatgtactgtttggtagggtaggtagagaagctgtgctttgaccctgtgattccatctttttctaccttctatgatggtgatgaagctagatacccctagggaagaaagaaggactgggtttagcaaaaatgatttggtaattaaagtttatttgaac

SEQ ID NO: 186177 - DNA, 3053 bp, Homo sapiens
  Payload ID: 16663
  Gene Symbol: SPRYD7
  Gene Name: SPRY domain containing 7
  Uniprot ID: Q5W111
  ENST ID: ENST00000361840
  CDS Start-End: 106-696
atagacaagtccggacctcgggcgggggcaggagacggagctgagcggcggggggcagtgtcgcctcggtctagggacggcggcggagtcggtggtccctgcgcgatggccacctcggtgttgtgctgcctgcggtgctgcagagacggggggactggccacatccctctgaaggagatgccggccgtgcagctggacacgcagcacatgggaacagatgttgttattgtaaagaatggaagaagaatatgtggaacaggaggttgtttagccagcgcacctttacatcaaaacaaaagctattttgaattcaaaatccagtccacaggaatctggggtattggtgttgcaactcagaaggttaacttgaatcagattcctcttggccgagatatgcacagtctggtgatgagaaatgatggagccctttaccacaacaatgaagagaaaaataggctgccagcaaacagtcttccgcaggaaggagatgtggtgggtattacttatgaccatgtcgaattaaatgtatacttgaatggaaaaaacatgcattgtccagcatcaggtatacgagggacagtgtatccagttgtttatgttgatgacagtgcaattttggattgccagttcagtgagttttatcatacgcctccacctggttttgaaaaaatattatttgaacagcaaatcttctgaatgtatttgtttttaaaacttgtatttctgcactgttaaaaaatgttcatcatttaataaaactttacctggcctatagatgaaaatatattcttaaaaatatgcttgttgatgctgtctaaggaaccaatgtattcagtataccaccctgaagttgtgatttaaaatactttatgttttgtgaaatgaaaataagcatttgggcagtttatttaattcttatttaaataaatagaattatgggtttaattaacagtataacatgactatatatacatatatatttaaagggaattctttcttacataatatatttgttttgatagagatgtagagttgggtgggtgtttttgtcactctgaagtttagacctcattaaatatttgacatctacagttggataattttgccgcttagtgtccttttttatatacaatataacaaagtgagagaaatttatattactggcaatttcatttttggcagtctatttctgtatcatgtaccgcttttcttaaaacttaaattgcttattttgttgtgtaatgtcattgcttttgatttgctttgtgaaaggagataaacgtttcagtaattgtcagagcattttgttgcctcaggctgtgttacctcaatttcagagtaagtagtggttgattagtaatgtagtatacactggcagacatctagaatagtatgatgctttacatttaaatgaggttattcttttaaggacttttatttgtatgttttctgtaaggaataataaaataattgtaattaaggaatataccatactatattaaacacattcttcctattttgttagttatacactaaattcacatcacccgtgattatttcagttcagagataagtgaatcctcttcatgaccctgagtctttgcctggttcttaagaatcactgtcctttagttaacgccctgtgacctgaaccaatcactctatacatctttagatacgttgtctgttttcaaatgagcatggcaaggatgcatacatttccctcctttatcaactagaaacagtacattgttcaggaaaacatgagtgttagaattagaaagagatccaaattgtagttttgctgctcatcctattttctcctctccaagtctcagattcccatttataaaaggagcaatcatactgacataagattctatgattaaataaggtaatacatatataacaccttaataatcataggcacttgcgccaggcgcggtggctcacacctgtaatcccagcactttgggaggctgaggcgggaggatcacaaggtcaggagatcgagaccatcgtggctaacatggtgaaaccctggctctactaaaaaaatacaaaaaaaattagccaggtgtggtggcgggcgcctgtagttctagctactctggaggctgaggcaggagaatggcttgaacccgggagacggcgcttgcagtgagccgagattgccccactgcactccagcctaggcaacagagtgagactctgtctcaaaaaaaattaaaataaaataaaataaaaatcataggcacttagtaagtgtagtttcctggatggtaaagtatcagggaaagtggttttctttctttttttttttttctcgttttttttttgagacagagtctcaccttgtcacccaggctagagtgcagtggcacgatcttggctcactgcaacctctgcttcccaggtttaagcgattctcttgcctcagcctcccgagtaggtgggactacaggtgcccgccaccacgcccgtgtaatttttgtatttttagtagagatggggtttcaccatgttgtccaggctggtctcaaactcctgacctcatgatccacctccctcagcctcccaaagtgctggaattataggcgtaagccaccacacccagccagaaagtggttctcatgatgcttctcagaccggcaacatcagcatcactggaacttgttaaaaatggacactctcagaacccacaccagacccaccaaatcagtttgagaactgccattcagtagagaattatttgcctactgtaaattttctaaggatttatgatgggctatttttgacccataggctcagagaatcctgcaaaatccttttttattgtttattctgcagacaaaaatgtgacaatatgctttgaaaacatagatatacttgagtaacatttatttacataaatcccaaattctacctctgaaggtatatgaaatttaactatgtatgtattatgcattttgtctggctttctatcataattttaatttgtaaagaatgtgcttacttgggaaagcaaattaaagtgactactgtttgctatc

SEQ ID NO: 186178 - DNA, 3086 bp, Homo sapiens
  Payload ID: 16663
  Gene Symbol: SPRYD7
  Gene Name: SPRY domain containing 7
  Uniprot ID: Q5W111
  ENST ID: ENST00000378195
  CDS Start-End: 256-729
ccgtctccccggcccagcccggccgctcgccctgtccggtctctccccggccccttgattctccgcgtcttcctcgcaggccagcctaagctcagcctgcattgcgccctcccggcctagggtgtcgctgtaccggcctccgagctccacatagacaagtccggacctcgggcgggggcaggagacggagctgagcggcggggggcagtgtcgcctcggtctagggacggcggcggagtcggtggtccctgcgcgatggccacctcggtgttgtgctgcctgcggtgctgcagagacggggggactggccacatccctctgaaggagatgccggccgtgcagctggacacgcagcacatgggaatctggggtattggtgttgcaactcagaaggttaacttgaatcagattcctcttggccgagatatgcacagtctggtgatgagaaatgatggagccctttaccacaacaatgaagagaaaaataggctgccagcaaacagtcttccgcaggaaggagatgtggtgggtattacttatgaccatgtcgaattaaatgtatacttgaatggaaaaaacatgcattgtccagcatcaggtatacgagggacagtgtatccagttgtttatgttgatgacagtgcaattttggattgccagttcagtgagttttatcatacgcctccacctggttttgaaaaaatattatttgaacagcaaatcttctgaatgtatttgtttttaaaacttgtatttctgcactgttaaaaaatgttcatcatttaataaaactttacctggcctatagatgaaaatatattcttaaaaatatgcttgttgatgctgtctaaggaaccaatgtattcagtataccaccctgaagttgtgatttaaaatactttatgttttgtgaaatgaaaataagcatttgggcagtttatttaattcttatttaaataaatagaattatgggtttaattaacagtataacatgactatatatacatatatatttaaagggaattctttcttacataatatatttgttttgatagagatgtagagttgggtgggtgtttttgtcactctgaagtttagacctcattaaatatttgacatctacagttggataattttgccgcttagtgtccttttttatatacaatataacaaagtgagagaaatttatattactggcaatttcatttttggcagtctatttctgtatcatgtaccgcttttcttaaaacttaaattgcttattttgttgtgtaatgtcattgcttttgatttgctttgtgaaaggagataaacgtttcagtaattgtcagagcattttgttgcctcaggctgtgttacctcaatttcagagtaagtagtggttgattagtaatgtagtatacactggcagacatctagaatagtatgatgctttacatttaaatgaggttattcttttaaggacttttatttgtatgttttctgtaaggaataataaaataattgtaattaaggaatataccatactatattaaacacattcttcctattttgttagttatacactaaattcacatcacccgtgattatttcagttcagagataagtgaatcctcttcatgaccctgagtctttgcctggttcttaagaatcactgtcctttagttaacgccctgtgacctgaaccaatcactctatacatctttagatacgttgtctgttttcaaatgagcatggcaaggatgcatacatttccctcctttatcaactagaaacagtacattgttcaggaaaacatgagtgttagaattagaaagagatccaaattgtagttttgctgctcatcctattttctcctctccaagtctcagattcccatttataaaaggagcaatcatactgacataagattctatgattaaataaggtaatacatatataacaccttaataatcataggcacttgcgccaggcgcggtggctcacacctgtaatcccagcactttgggaggctgaggcgggaggatcacaaggtcaggagatcgagaccatcgtggctaacatggtgaaaccctggctctactaaaaaaatacaaaaaaaattagccaggtgtggtggcgggcgcctgtagttctagctactctggaggctgaggcaggagaatggcttgaacccgggagacggcgcttgcagtgagccgagattgccccactgcactccagcctaggcaacagagtgagactctgtctcaaaaaaaattaaaataaaataaaataaaaatcataggcacttagtaagtgtagtttcctggatggtaaagtatcagggaaagtggttttctttctttttttttttttctcgttttttttttgagacagagtctcaccttgtcacccaggctagagtgcagtggcacgatcttggctcactgcaacctctgcttcccaggtttaagcgattctcttgcctcagcctcccgagtaggtgggactacaggtgcccgccaccacgcccgtgtaatttttgtatttttagtagagatggggtttcaccatgttgtccaggctggtctcaaactcctgacctcatgatccacctccctcagcctcccaaagtgctggaattataggcgtaagccaccacacccagccagaaagtggttctcatgatgcttctcagaccggcaacatcagcatcactggaacttgttaaaaatggacactctcagaacccacaccagacccaccaaatcagtttgagaactgccattcagtagagaattatttgcctactgtaaattttctaaggatttatgatgggctatttttgacccataggctcagagaatcctgcaaaatccttttttattgtttattctgcagacaaaaatgtgacaatatgctttgaaaacatagatatacttgagtaacatttatttacataaatcccaaattctacctctgaaggtatatgaaatttaactatgtatgtattatgcattttgtctggctttctatcataattttaatttgtaaagaatgtgcttacttgggaaagcaaattaaagtgactactgtttgctatc

SEQ ID NO: 186179 - DNA, 2285 bp, Homo sapiens
  Payload ID: 16663
  Gene Symbol: SPRYD7
  Gene Name: SPRY domain containing 7
  Uniprot ID: Q5W111
  ENST ID: ENST00000613924
  CDS Start-End: 73-546
gacggagctgagcggcggggggcagtgtcgcctcggtctagggacggcggcggagtcggtggtccctgcgcgatggccacctcggtgttgtgctgcctgcggtgctgcagagacggggggactggccacatccctctgaaggagatgccggccgtgcagctggacacgcagcacatgggaatctggggtattggtgttgcaactcagaaggttaacttgaatcagattcctcttggccgagatatgcacagtctggtgatgagaaatgatggagccctttaccacaacaatgaagagaaaaataggctgccagcaaacagtcttccgcaggaaggagatgtggtgggtattacttatgaccatgtcgaattaaatgtatacttgaatggaaaaaacatgcattgtccagcatcaggtatacgagggacagtgtatccagttgtttatgttgatgacagtgcaattttggattgccagttcagtgagttttatcatacgcctccacctggttttgaaaaaatattatttgaacagcaaatcttctgaatgtatttgtttttaaaacttgtatttctgcactgttaaaaaatgttcatcatttaataaaactttacctggcctatagatgaaaatatattcttaaaaatatgcttgttgatgctgtctaaggaaccaatgtattcagtataccaccctgaagttgtgatttaaaatactttatgttttgtgaaatgaaaataagcatttgggcagtttatttaattcttatttaaataaatagaattatgggtttaattaacagtataacatgactatatatacatatatatttaaagggaattctttcttacataatatatttgttttgatagagatgtagagttgggtgggtgtttttgtcactctgaagtttagacctcattaaatatttgacatctacagttggataattttgccgcttagtgtccttttttatatacaatataacaaagtgagagaaatttatattactggcaatttcatttttggcagtctatttctgtatcatgtaccgcttttcttaaaacttaaattgcttattttgttgtgtaatgtcattgcttttgatttgctttgtgaaaggagataaacgtttcagtaattgtcagagcattttgttgcctcaggctgtgttacctcaatttcagagtaagtagtggttgattagtaatgtagtatacactggcagacatctagaatagtatgatgctttacatttaaatgaggttattcttttaaggacttttatttgtatgttttctgtaaggaataataaaataattgtaattaaggaatataccatactatattaaacacattcttcctattttgttagttatacactaaattcacatcacccgtgattatttcagttcagagataagtgaatcctcttcatgaccctgagtctttgcctggttcttaagaatcactgtcctttagttaacgccctgtgacctgaaccaatcactctatacatctttagatacgttgtctgttttcaaatgagcatggcaaggatgcatacatttccctcctttatcaactagaaacagtacattgttcaggaaaacatgagtgttagaattagaaagagatccaaattgtagttttgctgctcatcctattttctcctctccaagtctcagattcccatttataaaaggagcaatcatactgacataagattctatgattaaataaggtaatacatatataacaccttaataatcataggcacttgcgccaggcgcggtggctcacacctgtaatcccaaagtgctggaattataggcgtaagccaccacacccagccagaaagtggttctcatgatgcttctcagaccggcaacatcagcatcactggaacttgttaaaaatggacactctcagaacccacaccagacccaccaaatcagtttgagaactgccattcagtagagaattatttgcctactgtaaattttctaaggatttatgatgggctatttttgacccataggctcagagaatcctgcaaaatccttttttattgtttattctgcagacaaaaatgtgacaatatgctttgaaaacatagatatacttgagtaacatttatttacataaatcccaaattctacctctgaaggtatatgaaatttaactatgtatgtattatgcattttgtctggctttctatcataattttaatttgtaaagaatgtgcttacttgggaaagcaaattaaagtgactactgtttgc

SEQ ID NO: 186180 - DNA, 4684 bp, Homo sapiens
  Payload ID: 16664
  Gene Symbol: SUPT16H
  Gene Name: SPT16 homolog, facilitates chromatin remodeling subunit
  Uniprot ID: Q9Y5B9
  ENST ID: ENST00000216297
  CDS Start-End: 340-3483
ggcagaccgtcacgtgacgacgtcgattcgcgtgcggcagtggcgaagttgacaaaccccgcgaaaatcgactctttgcatcgcacattttgttgattttccctcgtttttctttctctctttcccccgtccatccgaaagagggttggaaaaaaacaaaacaaacaaacaaacaaaaaaaaaacctaacgctgttgggacccggaagcggaaagggcatctttgaggtcgatacttccgggtcattgggagagtgcgggattcctgggccgagagcgggtggctgagccgggacctcgcgtgattctcggaacccgaggagaagcggcgtccggggctatggctgtgactctggacaaagacgcttattatcggcgagtgaagagactgtacagcaattggcggaaaggagaagatgagtatgccaacgttgatgccattgttgtatcagtgggtgttgatgaagaaattgtttatgccaaatcaactgccttacagacatggctctttggttatgaactaactgatactatcatggtcttttgtgatgacaaaatcatctttatggccagcaagaaaaaagtggagttcttgaaacagattgccaacactaagggcaatgagaatgctaatggagcccctgccatcacactgctaatacgagaaaagaatgaaagtaataagagtagctttgacaaaatgattgaagccattaaagaaagcaagaatggcaagaagattggagtgttcagcaaagacaaattccctggagagttcatgaagagctggaatgactgcctcaacaaagaaggctttgacaaaatagatatcagtgcagttgtggcatataccatcgctgtaaaggaggatggggagctcaacctaatgaagaaagcagccagcatcacttctgaagtcttcaacaaattcttcaaggaaagagtcatggaaatagttgatgcagatgagaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgagtgacaagaatcatatgcactttggggctatcacttgtgccatgggtattcgcttcaagtcttactgctccaaccttgttcgcactttgatggttgatccttctcaagaagttcaagaaaattataactttttgctccagcttcaagaggagctgctgaaggaattaagacatggtgtgaagatatgtgacgtgtataacgctgtcatggacgtggttaaaaagcagaagccagaactgctgaacaaaattaccaaaaacctagggtttgggatgggaattgaattccgtgaaggctccctagtaatcaatagcaaaaatcaatacaaactgaagaaaggaatggttttcagcatcaatttaggattctcagacctgactaacaaggaggggaaaaagccagaagagaaaacctatgccctgttcattggtgacacagtgcttgtggatgaggatggcccagctactgttctcacttctgtgaagaagaaagtgaagaatgtggggattttcctaaagaatgaagatgaggaagaagaggaggaggagaaagatgaggcagaggaccttttgggaagaggttctcgggcagcattacttacagaaagaacaagaaatgaaatgactgcagaagagaagcgaagagcacatcagaaagaactagcggctcaactcaatgaagaagcaaagaggcgattgactgaacaaaagggagaacagcagattcagaaagctcgcaagtctaatgtgtcctataaaaacccatctctgatgcctaaggaaccacatattcgggaaatgaagatctacatcgataagaaatatgagactgtaataatgcccgtgtttggcattgcaacaccgtttcacattgccacaatcaagaatataagtatgtccgtggaaggagattatacttacttgcgaatcaacttttattgcccaggcagtgctctgggcaggaatgaaggcaacatctttcctaaccctgaagcgacttttgtcaaggaaattacataccgagcatcaaatattaaggcacccggagaacagacagtaccagccttgaaccttcagaatgctttccgaattattaaagaagtacagaaacgttataaaactcgagaagctgaagagaaagagaaggaggggattgtaaaacaagactcactggtgatcaatctaaaccggagtaatccgaaactgaaagatctatacattcgcccaaatattgcccaaaagaggatgcaaggctcactggaggcccatgtcaatggcttccgcttcacatctgttcgaggagacaaagtggatattttgtacaataatattaagcatgctttgttccagccctgtgatggagaaatgattattgtcttgcactttcacctcaagaatgccatcatgtttgggaagaagcggcacacggatgtgcagttctacacagaagtgggagagataaccacggacttggggaaacatcagcatatgcatgaccgagatgacctctatgctgagcagatggaacgagaaatgaggcacaaactgaaaacagcctttaaaaatttcattgagaaagtagaggctctaactaaggaggaactggaatttgaagtgccttttagggacttgggatttaacggagctccctataggagtacctgcctccttcagcccactagtagtgcgctggtaaatgctacggaatggccaccttttgtggtgacattggatgaggtagagctgatccactttgagcgggtccagtttcacctgaagaactttgatatggtaatcgtctacaaggactacagcaagaaagtgaccatgatcaacgccattcctgtagcctctcttgaccccatcaaggaatggttgaattcctgcgacctgaaatacacagaaggagtacagtccctcaactggactaaaatcatgaagaccattgttgatgaccctgagggcttcttcgaacaaggtggctggtctttcctggagcctgagggtgaggggagtgatgctgaagaaggggattcagagtctgaaattgaagatgagacttttaatccttcagaagatgactatgaagaggaagaggaggacagtgatgaagattattcatcagaagcagaagagtcagactattctaaggagtcattgggtagtgaagaagagagtggaaaggattgggatgaactggaggaagaagcccgaaaagcggaccgagaaagtcgttacgaggaagaagaagaacaaagtcgaagtatgagccggaagaggaaggcatctgtgcacagttcgggccgtggctctaaccgtggttccagacacagctctgcaccccccaagaaaaagaggaagtaacttctgaactttggccctgagctccattcttcctccagccaacccctgaaaattttacatgacatagaaactgtatttttcctttcgttttcatttgaagttttgccatttgtgtttatgggtttagggggccatttgtgtggaccaatctactcggggaattccaggcccaccaggacacgtgccaatggccccattcagatggcaagggaggaggtgttcttgaagacaggaggaggctcccgctgttaataaatattgtttcattcttctctcttcctgtcaccttctgccaagacattgatggcttctgacatcttatttggtgtctcaaagctgtatttccaagacagtggtacaaggtgacccttaattacccgtatcatggttcttgaccagcacattcaatcctccaacctaccctactgccatgaccttccgcacatctctaagttttatctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttatatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgtttttgtaaattca

SEQ ID NO: 186181 - DNA, 915 bp, Homo sapiens
  Payload ID: 16664
  Gene Symbol: SUPT16H
  Gene Name: SPT16 homolog, facilitates chromatin remodeling subunit
  ENST ID: ENST00000555943
  CDS Start-End: 55-306
gagccgggacctcgcgtgattctcggaacccgaggagaagcggcgtccggggctatggctgtgactctggacaaagacgcttattatcggcgagtgaagagactgtacagcaattggcgggaattcccgggttctgtgcctcacccttttcgttgctcccgaatcattcaccggaggcggccacgaacgctgccccttaacagggaatcccccgcattcaccctgtcctgcggccatcaccatcttccccgcgtgccagccttggtcatgcatagcagcacctctcgcagtctcttcccgccctagaagaggcaacatccttccctcctactccgtggtcacgtcttgctgccctcccctgccgtgttctcacgcactcgctctgtccctccagaaccacaatattccacccctggtcccgccaggattataaccgtcttcgtaaaggagagatggaagggcaaggaggatgtcaatcgggcttttagcgtttatcgtttgcggggcttttgctggagttaaaaaaagaaatactgctcacgcgcaaccgcctcatgttctaggccctgctgtgggttacagagagggacctaacgctgaaagcctgcaggcattagtaataacaaaacaaaacaaaacgatgcctaaaaccttattagttccttggtagcgtatccggggcacgtgttcattaaaagagctgtggcagttcccagttttttaaagattcggcagttttgctgctctaaaaacgtccacagttaaaacttatttttatgatgttaacttactaattgagcaaacatttggttgcattctgtgatgcagtctgagttggctagcttaagtcttgcccctgaaccctgtcatcaagggaagatacagctaataaagatttttttttaacctgaaaaa

SEQ ID NO: 186182 - DNA, 877 bp, Homo sapiens
  Payload ID: 16664
  Gene Symbol: SUPT16H
  Gene Name: SPT16 homolog, facilitates chromatin remodeling subunit
  ENST ID: ENST00000557652
  CDS Start-End: 69-314
gagagcgggtggctgagccgggacctcgcgtgattctcggaacccgaggagaagcggcgtccggggctatggctgtgactctggacaaagacgcttattatcggcgagtgaagagactgtacagcaattggcggaaaggagaagatgagtatgccaacgttgatgccattgttgtatcagtgggtgttgatgaagaaattgtttatgccaaatcaactgccttacagtcttcagggacccaggctttttccagttctctgttctgccacccaaagaacatagccctcttgcacgtggtacagaatggcttctagaactccaggtgtttcatctacattccaagcaaaaagagacagagaagaaaacaggaggccaccttttctttttaagaagacttgcttgaagctccacacactaccattttttacctattggccaaaatttgatcctaatgaccatacttacctgaaaggaagacatggctctttggttatgaactaactgatactatcatggtcttttgtgatgacaaaatcatctttatggccagcaagaaaaaagtggagttcttgaaacagattgccaacactaagggcaatgagaatgctaatggagcccctgccatcacactgctaatacgagaaaagaatgaaagtaataagagtagctttgacaaaatgattgaagccattaaagaaagcaagaatggcaagaagattggagtgttcagcaaagacaaattccctggagagttcatgaagagctggaatgactgcctcaacaaagaaggctttgacaaaatagatatcagtgcagttgtggcatataccatcgctgtaaaggaggatggggagctcaacctaatgaagaaagcagc

SEQ ID NO: 186183 - DNA, 582 bp, Homo sapiens
  Payload ID: 16664
  Gene Symbol: SUPT16H
  Gene Name: SPT16 homolog, facilitates chromatin remodeling subunit
  ENST ID: ENST00000556309
  CDS Start-End: 20-220
agaagcggcgtccggggctatggctgtgactctggacaaagacgcttattatcggcgagtgaagagactgtacagcaattggcggaaaggagaagatgagtatgccaacgttgatgccattgttgtatcagtgggtgttgatgaagaaattgtttatgccaaatcaactgccttacagcaagaaaaaagtggagttcttgaaacagattgccaacactaagggcaatgagaatgctaatggagcccctgccatcacactgctaatacgagaaaagaatgaaagtaataagagtagctttgacaaaatgattgaagccattaaagaaagcaagaatggcaagaagattggagtgttcagcaaagacaaattccctggagagttcatgaagagctggaatgactgcctcaacaaagaaggctttgacaaaatagatatcagtgcagttgtggcatataccatcgctgtaaaggaggatggggagctcaacctaatgaagaaagcagccagcatcacttctgaagtcttcaacaaattcttcaaggaaagagtcatggaaatagttgatgcagatgagaaagttc

SEQ ID NO: 186184 - DNA, 5754 bp, Homo sapiens
  Payload ID: 16665
  Gene Symbol: SPTY2D1
  Gene Name: SPT2 chromatin protein domain containing 1
  Uniprot ID: Q68D10
  ENST ID: ENST00000336349
  CDS Start-End: 237-2294
taaaagcggaagttacgcagggactcgcgagcgctgtggcggccctgaaaggatataggccgtggagggaagggggcgggcagacggcataggaaggcgccggaagtggtcccgcagaggcggggtgggagtggggctcccgaggcagtgcagttggctgtagctgggcgcctcggttaggtgcgctgtcagtcctttccgagtgcctggcccagtctctcccgcctcggcccaacatggacttcagagaaattctcatgatagcttccaagggacaaggtgtcaacaatgtgccgaaaaggtatagtttggcagtggggcctccaaaaaaagacccaaaagttaaaggtgtccaatcagcagctgtacaagcttttcttaaaaggaaagaagaggagctgagacgaaaagccttagaggagaaaaggagaaaagaggaactagtgaaaaagcgaattgagctcaaacatgacaagaaagcaagagctatggccaagaggacaaaggataatttccatggttacaatgggattcctattgaggaaaagtcaaagaagaggcaggcaacagaaagccataccagccaaggaaccgaccgagagtatgaaatggaagaagagaatgaattcctcgagtacaatcacgcagagtcagagcaggagtatgaggaagagcaagaacctcccaaagttgaaagcaaaccaaaggtcccccttaaaagtgccccaccacccatgaacttcactgatttactcaggctggctgagaaaaagcagtttgaaccagtggaaatcaaggtagtgaagaaatcagaagagcgacctatgaccgcagaagaacttagggagcgagaattccttgaacgaaagcataggagaaaaaaacttgagacagatggaaaactacctccaactgtgtccaaaaaggcaccctctcagaaagaaagtgtgggcacaaaacttagcaaaggttctggagacaggcatccttcttccaaaggaatgccccttcctcatgctgagaagaaatcaagacccagcatggccaatgagaaacacctcgctttgtcttcatccaaatccatgccaggagagaggatcaaggcaggatctggcaatagctcccaaccctcacttcgtgagggccacgacaaacctgtttttaatggagctggaaagcctcattccagcacctcttcaccaagtgtcccaaagacttctgctagcaggactcagaaatctgctgttgagcacaaagccaaaaaatctctgtcccatcctagccattccaggcctgggcccatggtcaccccacacaataaggctaagagtccaggtgtcaggcagccaggcagcagctctagctcagcccctgggcagcccagcacaggggttgctcgacccacagttagttctggccctgtgcctaggcgccagaatggcagctccagctcaggacctgagcgatcaatcagtgggtccaagaagccaaccaatgactcaaatccctctaggcggacagtcagtggtacatgtggccctggacaacctgcaagcagctcaggtggccctgggcgacccatcagtggttcagttagttctgcaagacccttgggcagctctcgtggccctggccggcctgtgagcagtccacatgaacttcgacgaccagtgagtggcttgggccccccggggcggtctgtcagtggccctgggagatccataagtggctcaattccagctggacggactgtcagtaattcagtcccaggaagaccagtgagcagcttgggacctgggcaaacagttagtagctcaggtcccactataaagcctaagtgcactgttgtctccgaaacaatttcttccaagaatatcattagccggtccagcaatggacagatgaatggaatgaagcctcccctatctggctacagagctgcccaaggtcctcaaaggcttcccttccctactggttacaaaaggcagcgagaatatgaagaggaagatgacgatgatgatgaatacgactctgaaatggaagattttattgaagatgaaggagagcctcaggaagaaatatccaagcacattagagaaatctttggttatgaccgaaaaaaatacaaagatgaaagtgattatgccttacgttacatggaaagtagttggaaagagcagcagaaggaagaagcaaagagcttaagactgggtatgcaagaggacttagaggaaatgagacgtgaagaagaagaaatgcaacgtcgaagggccaagaagctgaagaggcgttagctgctgcttttatttttgtgaaattctagagctgctctgctgcaaggatttcctgccttcagactgaagaagcccccttatcattttagatttatacttgggtactcaaggagaaggaatgcatactgtcatttgcaggctgtcatttgagcataaaatattttcagatattttccagggtgaaatctgtaatgcagatgatataatgcccacttgtgctcttatgaagttaactgttcacagatgccagccttgatcctgatgagctatgcactctaatgtggggccactcaccagtcagccaatcttttattgttcctttgctactttgaaaggaaaaaaaaggttgtctcttgatttctgtaattcttctgctgatctgtgagtagggcactgccctgctcccaatcaaacttagtctttttatgagaaacctggaccttccatgaatgttgccagcaataaagtgacttgtcctaatctatggattgagaacttgaaaatgtagagtagaatttataactatcatatggatgtcatcctgtgactttgaagtacaaagtagaataaattctgtattcatggattggatgctgagcattcttactcattaatttaggtggctaggaattaatgaaaaaattttcaagttaaaatacaggttataacagtataatattcttttctaagttttcctttcagatttactgttatgttggctttagtgtaagacaaggtcactgtgctgattgatttttatctaaaaaaattcatttttatatcgaagaaaaaatattttattcaaacattagatttgaaagagtaatagtttataaaataaggaagtaacatgtgaggctctcccctcctcccctcccccatcataaagatattttgaaatcccaaggtgccctcatacctcttgacattaatgacttcattttttagcttgaatttgttagcaaatattaatggcagaaaaccaaaaactaaatttatggtatcgagagcaccaccttctctttttgcccatattgcactttgatttcaaactatgcactgtgaagagatttttttccccaggtaggaagggatgttccctgttatcgttattttactgagctgtggaaactcatttttaccctttttaaagtcataaatatggacttaatagcccttaaccttcaagtccaagcagttccaatcaggctgacttaggatcatgctggaaggaagccaagtctcaagaactgtcagcaacagaaaatgagatatgatgctagagagcatttgtccttgactgtaagtacagaggcttaggggaagtgagacataagcttgtaggaataataaacgttctacaataaacgttttggctatcttaagccattgtatgggggggattaggaagtaggagggattgtcctacaacaggcccttatacttcaacagcccaaatattttggtttattcctttttatccataaagtctttattcttcaagtttgggtattatagattaccattgttagcctcccttaatgggaccatatgagccaggcttttaagacggactcattttgaattgagtttcaaactttgaaagtgcaaggatttaatttttaagttgaatcccatgaaaggtgtcatcatcactaggaataacaccctttgtaactacatatagaactgttacaatggtagcagaaaatcctattgatttcatctcacccatttcagataccttcagtgaaattaagggtagtgtgatgtcccatgtaataaaacaggcttagaacatcaattcctctgctgccatttatgtgcttttattcccccttcaaaaattttttattggatatatatatttttcagtattcagactctgaaatctgtcattacaatcaagtgcttgtcacagctgaaagatttctggtggcttaaagtttactagcagtaaatttatgatatggtacagttctttgtacagaaaggcaccattatgttagaataaatttccagaacttagtgggaagaatcaggttttaaccttgtgtgtctgttacttctgagtgcatttctataatataaatgttgatttgcgtcaacattataaaagagcacttctgtggctcatttaaaagaaaaaaaaggttaagtcttttaaattttggccttgtttccaaatcctgtcttccatgttgtttttctgcacttcctgaccactcttataaaaagctcacaaacctttgaagaaactggagtaggctgttatttcattaaggtttacaaattaaatgcttgatttttaatgtattctctactgttttgatttttggattttcttaattcaacatttgaagatgtgccttttgggtaatgttaatcacgaatgtagtaatatttcatgattgtaataatgttacatgatcatgggtgtggcattctctaacaaatgatgtgaaaggaaagtagttttcataaaactcatggctctgattgcacagtcccacttgcttttgatattgctatgtcaaagcaaagggcacttcttttaaggctactttcagaactttgtattttcgctaaactataaatgcagttgtgtccagttggaggccagggtaccacatgtcacaggcggccttacatgtgtgccgtgaaaaggttcaaagaccgttaacaaaaaagtaagtctggccgggcatggtggctcaagcctgtaatcccagcactttgggaggccgaggcgggcggatcacttgagaccaggagttcgagaccagcctggccaacatggtgtgagaccccgtctctactaaaaataaaaaaattagccgggtgcggtggcacacacctgtaatcccagctaccggggaggctgaggcaggagaatcgctagaacctgggaggcggaggttgcagtcagccaagatagcaccactgcactccaggctgggtgacagagcgagactccatgtcaaaaaaaaaagaatgtgggaactcaaattttcatttttaatgtaatccccaagattttctccaagaaataaattgttgttttgtattttgtaacttaaaagcagctattggtaaatttctgagatatagcaggagaccaaaacatgtttggaaagagaataaatatatgaagagagactggttgttttattttcaatgtattgaatatattagactactatttattttctgagtggatgtgattaaatattcagacgtttagtgtatgattaagagtgagatagagatttctttggagtaattaaatccatcctgtcttttacacaatggacaaatcaagttaaaaaaatttttagatagcttagcttgttttctggtgctgttgacctgcaagagaatatacttttgcatatacaggtgaaagttttgcaatttatgtatacaagaaattgtaggcattaaaaatattttattgata

SEQ ID NO: 186185 - DNA, 2739 bp, Homo sapiens
  Payload ID: 16666
  Gene Symbol: SUPT20H
  Gene Name: SPT20 homolog, SAGA complex component
  Uniprot ID: Q8NEM7
  ENST ID: ENST00000350612
  CDS Start-End: 222-2561
tcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgtgttgtctcagcttggctctgccgagaacagacctgagcaaagccttcctcagcagagattccagctctcctctgcctttcaacagcagcagcaacagatacaacagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaa

SEQ ID NO: 186186 - DNA, 2681 bp, Homo sapiens
  Payload ID: 16666
  Gene Symbol: SUPT20H
  Gene Name: SPT20 homolog, SAGA complex component
  Uniprot ID: Q8NEM7
  ENST ID: ENST00000356185
  CDS Start-End: 265-2466
ggtgcagcactgagccgccgacggggcgggtgggctttgctgccgagcaggcggcgccgtcttggggcctagcggcgaggcgacccgcacaggtgggcggtggcggtaggtgggtggccagcgactggcaacgcggtggcttagacgcgcgagatccggccagggtcagagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagcagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaa

SEQ ID NO: 186187 - DNA, 2843 bp, Homo sapiens
  Payload ID: 16666
  Gene Symbol: SUPT20H
  Gene Name: SPT20 homolog, SAGA complex component
  Uniprot ID: Q8NEM7
  ENST ID: ENST00000360252
  CDS Start-End: 249-2450
tccccgcccctcggcccagcctgccaatcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagcagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttg

SEQ ID NO: 186188 - DNA, 2836 bp, Homo sapiens
  Payload ID: 16666
  Gene Symbol: SUPT20H
  Gene Name: SPT20 homolog, SAGA complex component
  Uniprot ID: Q8NEM7
  ENST ID: ENST00000475892
  CDS Start-End: 185-2620
gtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaac

SEQ ID NO: 186189 - DNA, 2625 bp, Homo sapiens
  Payload ID: 16666
  Gene Symbol: SUPT20H
  Gene Name: SPT20 homolog, SAGA complex component
  Uniprot ID: Q8NEM7
  ENST ID: ENST00000464744
  CDS Start-End: 332-2533
agagacccggcaggccggggcggaggttgaggcagctaaactccaggtggacgcctacatcgcctttcgcggtgttgctaagccgaacttttaattttagtttgacttttgggttccagagacgggtatttccggacactggcaagaattttgccttgcgtgtcttcgaaggcggttttcttggtgtccatattgcataaaggcttgtcgctcctctgtggagatgacggttgtacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagcagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaag

SEQ ID NO: 186190 - DNA, 1313 bp, Homo sapiens
  Payload ID: 16666
  Gene Symbol: SUPT20H
  Gene Name: SPT20 homolog, SAGA complex component
  ENST ID: ENST00000469488
  CDS Start-End: 1-1135
ttcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgtgttgtctcagcttggctctgccgagaacagacctgagcaaagccttcctcagcagagattccagctctcctctgcctttcaacagcagcagcaacagatacaacagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaa

SEQ ID NO: 186191 - DNA, 734 bp, Homo sapiens
  Payload ID: 16666
  Gene Symbol: SUPT20H
  Gene Name: SPT20 homolog, SAGA complex component
  ENST ID: ENST00000497318
  CDS Start-End: 165-734
cggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagcagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccag

SEQ ID NO: 186192 - DNA, 2478 bp, Homo sapiens
  Payload ID: 16666
  Gene Symbol: SUPT20H
  Gene Name: SPT20 homolog, SAGA complex component
  ENST ID: ENST00000542180
  CDS Start-End: 157-2367
ctctttttttttctcttaatagccttatgttaatattggggttttattgtttttgcttttcagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccaggagcactgaatcaaaagaattgagtttctactttttgttttttttaatgtgtcagtattttacattgctagatgtacaaactttatacagaagcacaaccttatcatttttaaataaaaacagggaaatggttt

SEQ ID NO: 186193 - DNA, 3669 bp, Homo sapiens
  Payload ID: 16666
  Gene Symbol: SUPT20H
  Gene Name: SPT20 homolog, SAGA complex component
  ENST ID: ENST00000495071
  CDS Start-End: 222-1718
tcggaagtgcggccgccggaactggctgttggtgggggtgcagcactgagccgccgacggggcgggtgggctttgctgccgagcaggcggcgccgtcttggggcctagcggcgaggcgacccgcacagtactgtaagattgatgttaaaggcatggtgttcaccccacttcatcagcgtacataagttatctcttcttttggacccttattttatgccataatgtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaatttttatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttg

SEQ ID NO: 186194 - DNA, 3811 bp, Homo sapiens
  Payload ID: 16666
  Gene Symbol: SUPT20H
  Gene Name: SPT20 homolog, SAGA complex component
  ENST ID: ENST00000490716
  CDS Start-End: 184-1752
ggaggaagacggggtccccagagacccggcaggccggggcggaggttgaggcagctaaactccaggtggacgcctacatcgcctttcgcgtactgtaagattgatgttaaaggcatggtgttcaccccacttcatcagcgtacataagttatctcttcttttggacccttattttatgccataatgtatgtcattgaaagtgcccgacagagacctcctaaaaggaaatacctatcaagtggaagaaaatctgtatttcaaaaactttatgacttgtatattgaagaatgtgaaaaagaacctgaagttaagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagacatgaaagctaaaaaagaaaacacctcaagagcttttggttttacttttttggtttttgttttttgtttttgttttttaaaaaattgataaactgtgcatacttcattcacaacagattttctatacattctacatttaaacagaagtacacagttactgttaaagatgcagtattatctctcagatatttgctttattactgttttttgtaaatttgtttgtcaggataaacttgatgtgttaggaattaaacatgtatatttaggtgccaaatatgattgttaaccatatgtaacttattaaatatgtttacagtttatctcagacttttacactaaataagcaatatttttaaatgaagtcttgaattagtgaaatcgtaaataacaaattaatttgaattcgttttgaactttttaggccaaaggcagcatgtaggaaactaacttttaaatgggtattgtggtagaatataactgtatatttttactgttactgcaatagcatctttaatgggatttttaggtgatatactgcatccttaattgtaattgagtgtagcaacactcatgtatcatgtgtagaaattaacacttgcagttaactgctaaaaaaaaaaaaactagaacaaattgtcagtgctaagtaagattccattaaccttattttaaaaggactggccatttataacaaactagcaatttttatttttctcaatgagcaggatctggaactcctaagccatctactcctacaccaaccccttcatcgaccccacaccctcctgatgctcagagctcaactcctagtaccccttcagccacccctactccccaagattcaggcttcacccctcagcccactttgttaactcagtttgctcagcagcaaaggtctctgagccaggcaatgcctgtaacaaccattcctctttccaccatggtaacatctataactccaggaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgtgttgtctcagcttggctctgccgagaacagacctgagcaaagccttcctcagcagagattccagctctcctctgcctttcaacagcagcagcaacagatacaacagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaa

SEQ ID NO: 186195 - DNA, 3857 bp, Homo sapiens
  Payload ID: 16667
  Gene Symbol: SUPT3H
  Gene Name: SPT3 homolog, SAGA and STAGA complex component
  ENST ID: ENST00000306867
  CDS Start-End: 274-771
attttgcaggtattctttaggtgatgctagaaggcctcttcatgaaacagcagttttggtagaagatgtggtacacactcagttaattaatctgttacagcaagctgctgaagtttctcagctgcggggagcaagggtaatcactcctgaagatcttctgtttttgatgcgcaaagataagacaaattgagtggcagcaataatgcgaacaaaagacaaaagattgctcaggacttcctcaactctattgaccagacaggagaacttttagcaatgtttgaagatgacgaaattgatgaagttaaacaagaaagaatggagagagcagaaagacaaactcgaattatggattcagctcaatatgcagaattctgtgaaagtcgacaattaagtttctccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaaatgcctaccgcaggaatgggatggcttttctagcctgctgatgtgacaactgtgatgtgcctgcaacaacaggaaaggcaatgttatattaaggtgatttcttgtgaacaaaataaaatacaaatttacctttcttttatctgagggagtgggctggtctgttgtgactttcaacttgctgactcctcctcttttccagcccctcaaccatcggtcttgtttactagatgggctgttcagctaattaatggcaggatgtttaggatagtctgtaggtggacaagaatgcagatcacacagttttgaaattttaatttgagtagatttactgccctcagctcacataccttaaaagcagtggttgcccccgtccagcgttttgtctgcattttatttgatatattttataatccaggtttggaacaaggaaacaaaattaaaaggacagtgagttttcgccttcccttacaccaccaactttactttccaacatttgttgacatgtgttttagtgacagctatccattttataaacttacagtaatcaaagatctaacagacctgataaatcacctgttcccacctcctttccccttcactccacttatagtatgtgtcattttcaatgcctgcttcccaacttcctgccatctgcctttcatgtgtgtttttcctcacacagaacctcttcctccatcttcatttccctccttttcctgttcctccaatccccagatccaccactcctgcacatgccatacacatttagaagccaagtattcagaatcagtagaaggggagcagagtgatttcttgcttcctcccttcaaagcactaccacacctagactggaaatgtgggctgggtaatttcttgctgttagcagccgagctacccttctggcatctatactttctccagtaaatgaggaaccgtaactctttggaacaaaccaaaatatagcagatgtaattgtacagttcctgattaaacttcagttgcaaaaaagaaagttatttctttaattctgtgggagttttgtataattttacttttatggtttttacacatacttgaaacactctttctaaagaattaataaaaacagaaatgagaaacatgaaagatctttttcttgatactgctcctttttcttgatactgctcaagagagcaagcctctcttgatactgcttcctagatttaagggtaaagaaagtagaaatagttctcccttcacccaaatttggaagtataaaactttctgaacatgccatttagaggttatgtcattagctttcctgccttcttatattgtaatagttgcgattcaaaaacactgtttcaattttaaattcaagactttttatttgaaaaccatcagactcaaagaattatgaggctcagttaatattattatgccacattatttacatttgttaactgtcatttacctgctctatgttaatctttttagaaaaaatttgcatttcagaaacaaaaagcacggatagatatataatatcaaaatattcccaaaggattttgatgttccatctatgcttgttaaaatgtatgattatgattaaactttttatcattcttattttccttggcatccataatcatggaaaattacaagcttgcagtaaacatcctaacttaacttaacttttaaacgatagcatttattgtatttggttttgatctgccaggcttatagatggtataaaattttcaggggataatttttcacatcaaaattccttctctcccacattatacattttaaagtatgcacaaggcagaaaatatagggtttgggtttttttccttcgttttattccacctgatctccttatagtcccagagaaggaagactcaatgtacatttctctcagaaatatgacaggtctgtgtttttgttggtctggcatatgtttgtctatcttgaacagtctgacaggtaattatttataaaatctggttttgcccagtaagttcatataaaacctttcatttttcatcataagccagtaagctgaatttagaataaagcaaggtcatttatgtctgtcctgaaccagcctacatgtccccataattgctcaatatttttaattcccttttctattttttatacttaggttctttctctgactctttgcacaatactaaatttgaagtgaaataaaacttccttcagcagtgactatagaaacaaaagaaaatttacagaaggaatgtttaagaaaacttcagtaaattattttctcaataatcataatgttagagcagaagatagtcttagagatcattaagaacagctgctcatcttgcaaatgaaaaaaccatggcctagagagggaaagtgagtttcctaagatcactcaataatgtagtgacagaccagagatgagaatcgatggtccctaattttcagtcggtattatacagtattttctaccatactgggttagcataagaatattactaagacatgttggggttttatggcatatttatcctagacaacgatgtaaatttatttaaaaactgtactaattatggatacatcctaaagcatacgtgttatatagtaaaatcttcagtgtgactgtggtattaagtaaacagtctgttatcttacacatcaggcttaactctaagtcaaatggaaatatacaaagctagtttctattttttgtcccttgtattttagagactgaatttgaaaataaataagccaataaataaatagcgtctcttgatactgcttcctagatttaagggtaaagaaagtagaaatatttctcccttcacctaaatttggaagtataactttctgaacgtgccatttagagggttatgccattagctttcctgccttcttagattgtaatcgttgtgattcaaaaatactgtttcaattttaaaaccaagactttttatttgaaaaccatcagaagcacaaatattttttaaatggtgtatataattcctgtatctggggagaacccttcatttattgctgttctttgtttttataaaataataaacaagccatgtctgatgcttttaccatgtagaagacaaataaacataactggtgattcttggtctgaaag

SEQ ID NO: 186196 - DNA, 728 bp, Homo sapiens
  Payload ID: 16667
  Gene Symbol: SUPT3H
  Gene Name: SPT3 homolog, SAGA and STAGA complex component
  ENST ID: ENST00000371458
  CDS Start-End: 358-684
ggggcattatggctgcctctgttgccccacgcaggtcgccagggaagtgggggaaagccagcagccgcaggcctcacccagctcccatgcagcccacagcccgaaaggccggtctcactccaccatgccctctgcccgtaacagcaccaactttatttccaggcagctggtgagcagggctgagaactttccccaggctaccggcttcctagctgagaaagcaagcctactcacagttcctctgcgtcccacagagcctgcagtggtgatccacctccttcaagggccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaatttctttttctttgacagaatgcctaccgcaggaatgggatggcttttctagcctgctgatgtgacaactgtgatgtgcctgcaacaacaggaaaggcaatgttatatt

SEQ ID NO: 186197 - DNA, 2091 bp, Homo sapiens
  Payload ID: 16667
  Gene Symbol: SUPT3H
  Gene Name: SPT3 homolog, SAGA and STAGA complex component
  Uniprot ID: O75486
  ENST ID: ENST00000371459
  CDS Start-End: 167-1120
cacagccgagtcaccttttccctttctacactccacactctcagtcccccaccccgcccctttccaagcgtgtcccgggccgcagcagcagaaaccgcaccatctccacccccacattctcctcgcgggaagcgcagcagtgcctccaagggttcttaaagcagagatgaataatacggcagctagtccaatgtctactgcaacttcaagtagtggaaggagtacagggaagtctataagctttgcaacagaattacagagtatgatgtattctttaggtgatgctagaaggcctcttcatgaaacagcagttttggtagaagatgtggtacacactcagttaattaatctgttacagcaagctgctgaagtttctcagctgcggggagcaagggtaatcactcctgaagatcttctgtttttgatgcgcaaagataagaaaaaacttagaagactgctaaaatacatgtttatccgagactacaaatcaaagattgtcaaaggcatcgatgaggatgatcttctcgaagacaaattgagtggcagcaataatgcgaacaaaagacaaaagattgctcaggacttcctcaactctattgaccagacaggagaacttttagcaatgtttgaagatgacgaaattgatgaagttaaacaagaaagaatggagagagcagaaagacaaactcgaattatggattcagctcaatatgcagaattctgtgaaagtcgacaattaagtttctccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaaatgcctaccgcaggaatgggatggcttttctagcctgctgatgtgacaactgtgatgtgcctgcaacaacaggaaaggcaatgttatattaaggtgatttcttgtgaacaaaataaaatacaaatttacctttcttttatctgagggagtgggctggtctgttgtgactttcaacttgctgactcctcctcttttccagcccctcaaccatcggtcttgtttactagatgggctgttcagctaattaatggcaggatgtttaggatagtctgtaggtggacaagaatgcagatcacacagttttgaaattttaatttgagtagatttactgccctcagctcacataccttaaaagcagtggttgcccccgtccagcgttttgtctgcattttatttgatatattttataatccaggtttggaacaaggaaacaaaattaaaaggacagtgagttttcgccttcccttacaccaccaactttactttccaacatttgttgacatgtgttttagtgacagctatccattttataaacttacagtaatcaaagatctaacagacctgataaatcacctgttcccacctcctttccccttcactccacttatagtatgtgtcattttcaatgcctgcttcccaacttcctgccatctgcctttcatgtgtgtttttcctcacacagaacctcttcctccatcttcatttccctccttttcctgttcctccaatccccagatccaccactcctgcacatgccatacacatttagaagccaagtattcagaatcagtagaaggggagcagagtgatttcttgcttcctcccttcaaagcactaccacacctagactggaaatgtgggctgggtaatttcttgctgttagcagccgagctacccttctggcatctatactttctccagtaaatgaggaaccgtaactctttggaacaaaccaaaatatagcagatgtaattgtacagttcctgattaaacttcagttgcaaaaaagaaa

SEQ ID NO: 186198 - DNA, 2389 bp, Homo sapiens
  Payload ID: 16667
  Gene Symbol: SUPT3H
  Gene Name: SPT3 homolog, SAGA and STAGA complex component
  Uniprot ID: O75486
  ENST ID: ENST00000371460
  CDS Start-End: 319-1305
cacagccgagtcaccttttccctttctacactccacactctcagtcccccaccccgcccctttccaagcgtgtcccgggccgcagcagcagaaaccgcaccatctccacccccacattctcctcgcgggaagcgcagcagtgcctccaagggttcttaaagcagagatgaataatacggcagctagtccaatgtctactgcaacttcaagtagtggaaggagtacagggaagtctataagctttgcaacagaattacagagtatgataaactgcttatcaataacagctgtagcactgtggcttttctccatggactcatggtggtctttggaacaacgttcttcaactttgacagcttcatagggaaaacagattctatagaaataattggaaaatcagtttttccctattgttatcacaatatccttccactgctgaatgattctggcaggtattctttaggtgatgctagaaggcctcttcatgaaacagcagttttggtagaagatgtggtacacactcagttaattaatctgttacagcaagctgctgaagtttctcagctgcggggagcaagggtaatcactcctgaagatcttctgtttttgatgcgcaaagataagaaaaaacttagaagactgctaaaatacatgtttatccgagactacaaatcaaagattgtcaaaggcatcgatgaggatgatcttctcgaagacaaattgagtggcagcaataatgcgaacaaaagacaaaagattgctcaggacttcctcaactctattgaccagacaggagaacttttagcaatgtttgaagatgacgaaattgatgaagttaaacaagaaagaatggagagagcagaaagacaaactcgaattatggattcagctcaatatgcagaattctgtgaaagtcgacaattaagtttctccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaaatgcctaccgcaggaatgggatggcttttctagcctgctgatgtgacaactgtgatgtgcctgcaacaacaggaaaggcaatgttatattaaggtgatttcttgtgaacaaaataaaatacaaatttacctttcttttatctgagggagtgggctggtctgttgtgactttcaacttgctgactcctcctcttttccagcccctcaaccatcggtcttgtttactagatgggctgttcagctaattaatggcaggatgtttaggatagtctgtaggtggacaagaatgcagatcacacagttttgaaattttaatttgagtagatttactgccctcagctcacataccttaaaagcagtggttgcccccgtccagcgttttgtctgcattttatttgatatattttataatccaggtttggaacaaggaaacaaaattaaaaggacagtgagttttcgccttcccttacaccaccaactttactttccaacatttgttgacatgtgttttagtgacagctatccattttataaacttacagtaatcaaagatctaacagacctgataaatcacctgttcccacctcctttccccttcactccacttatagtatgtgtcattttcaatgcctgcttcccaacttcctgccatctgcctttcatgtgtgtttttcctcacacagaacctcttcctccatcttcatttccctccttttcctgttcctccaatccccagatccaccactcctgcacatgccatacacatttagaagccaagtattcagaatcagtagaaggggagcagagtgatttcttgcttcctcccttcaaagcactaccacacctagactggaaatgtgggctgggtaatttcttgctgttagcagccgagctacccttctggcatctatactttctccagtaaatgaggaaccgtaactctttggaacaaaccaaaatatagcagatgtaattgtacagttcctgattaaacttcagttgcaaaaaagaaagttatttctttaattctgtgggagttttgtataattttacttttatggtttttacacatacttgaaacactctttctaaagaattaataaaaacagaaatgagaaacatgaaa

SEQ ID NO: 186199 - DNA, 1377 bp, Homo sapiens
  Payload ID: 16667
  Gene Symbol: SUPT3H
  Gene Name: SPT3 homolog, SAGA and STAGA complex component
  Uniprot ID: O75486
  ENST ID: ENST00000475057
  CDS Start-End: 187-1140
ccccccccatcgccccgtcacacagccgagtcaccttttccctttctacactccacactctcagtcccccaccccgcccctttccaagcgtgtcccgggccgcagcagcagaaaccgcaccatctccacccccacattctcctcgcgggaagcgcagcagtgcctccaagggttcttaaagcagagatgaataatacggcagctagtccaatgtctactgcaacttcaagtagtggaaggagtacagggaagtctataagctttgcaacagaattacagagtatgatgtattctttaggtgatgctagaaggcctcttcatgaaacagcagttttggtagaagatgtggtacacactcagttaattaatctgttacagcaagctgctgaagtttctcagctgcggggagcaagggtaatcactcctgaagatcttctgtttttgatgcgcaaagataagaaaaaacttagaagactgctaaaatacatgtttatccgagactacaaatcaaagattgtcaaaggcatcgatgaggatgatcttctcgaagacaaattgagtggcagcaataatgcgaacaaaagacaaaagattgctcaggacttcctcaactctattgaccagacaggagaacttttagcaatgtttgaagatgacgaaattgatgaagttaaacaagaaagaatggagagagcagaaagacaaactcgaattatggattcagctcaatatgcagaattctgtgaaagtcgacaattaagtttctccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaaatgcctaccgcaggaatgggatggcttttctagcctgctgatgtgacaactgtgatgtgcctgcaacaacaggaaaggcaatgttatattaaggagtaaaccaagccaattcagcacttcctgtttacttccttgtcatatgtaccatagatggtgacagacctgctctcaaaacaagcttccttcgtttaattctgcattttctgcttaggcaaccaccctatcaatatacttgaacaatgaaacaatttggctacggaagcactgtctctgaattc

SEQ ID NO: 186200 - DNA, 1489 bp, Homo sapiens
  Payload ID: 16668
  Gene Symbol: SUPT4H1
  Gene Name: SPT4 homolog, DSIF elongation factor subunit
  Uniprot ID: P63272
  ENST ID: ENST00000225504
  CDS Start-End: 68-421
tatttacttcctgcgggtgcacaggctgtggtcgtctatctccctgttgttcttcccatcggcgaagatggccctggagacggtgccgaaggacctgcggcatctgcgggcctgtttgctgtgttcgctggtcaagactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcagtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatgacacctgccttgcctccctcttccattctcttaggcacagtaatagcttatttgccctataagaaccttcccagagcagcagaggcccttctactccctcttgactgtctcagcctctgggattgcagcctttgtagtgtgcttccttgcttcctatcggagggtgctgatccagaggctcagtaaccccatcaacttggtggccctggtgtctcacacttgtatccttctgccctcgagacctggcacagcagtatcccttgaagaaatcctgaggctttgtagagtgctccttgaccatgtttaataattcttccctcccctgcttgtctattttcttctcttcacggctcttcctataccttaggccagtctcaagcactcactggagacccttgggccttgggcgaccattgagtcctagtctcccttgtttgtgcccctgtaggaggtaggtccttttctcctccggcctagtaggggaccttgggtaacatcccatttttcggccaaggtgagttgttttaggataaaaaaatttaccacaaattctcatttaaatttccacagaaatcctgttcgtatccccattttgatttccctaagttccttgttctccctctaaaaagagaatgattgcaccctgcctgtttacctcaggattgttgtgattgtagaaacgaagctatgtgaaaattatataagtattataaaggtgaaatacttttgctctc

SEQ ID NO: 186201 - DNA, 1643 bp, Homo sapiens
  Payload ID: 16668
  Gene Symbol: SUPT4H1
  Gene Name: SPT4 homolog, DSIF elongation factor subunit
  ENST ID: ENST00000577396
  CDS Start-End: 414-644
cgggggcccgctgactaccccacacagcctccgccgcgccctcggcgggctcaggtggctgcgacgcgctccggcccaggtggcggccggccgcccagcctccccgcctgctggcgggagaaaccatctcctctggcgggggtaggggcggagctggcgtccgcccacaccggaagaggaagtctaagcgccggaagtggtgggcattctgggtaacgagctatttacttcctgcgggtgcacaggctgtggtcgtctatctccctgttgttcttcccatcggcgaagatggccctggagacggtgccgaaggacctgcggcatctgcgggcctgtttgctgtgttcgctggtcaaggtactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcagtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatgacacctgccttgcctccctcttccattctcttaggcacagtaatagcttatttgccctataagaaccttcccagagcagcagaggcccttctactccctcttgactgtctcagcctctgggattgcagcctttgtagtgtgcttccttgcttcctatcggagggtgctgatccagaggctcagtaaccccatcaacttggtggccctggtgtctcacacttgtatccttctgccctcgagacctggcacagcagtatcccttgaagaaatcctgaggctttgtagagtgctccttgaccatgtttaataattcttccctcccctgcttgtctattttcttctcttcacggctcttcctataccttaggccagtctcaagcactcactggagacccttgggccttgggcgaccattgagtcctagtctcccttgtttgtgcccctgtaggaggtaggtccttttctcctccggcctagtaggggaccttgggtaacatcccatttttcggccaaggtgagttgttttaggataaaaaaatttaccacaaattctcatttaaatttccacagaaatcctgttcgtatccccattttgatttccctaagttccttgttctccctctaaaaagagaatgattgcaccctgcctgtttacctcaggattg

SEQ ID NO: 186202 - DNA, 318 bp, Homo sapiens
  Payload ID: 16668
  Gene Symbol: SUPT4H1
  Gene Name: SPT4 homolog, DSIF elongation factor subunit
  ENST ID: ENST00000579289
  CDS Start-End: 2-130
gatggccctggagacggtgccgaaggacctgcggcatctgcgggcctgtttgctgtgttcgctggtcaaggtgtcagtcggggacctggttgtagggcccatgggggaccaagactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcagtaactttaagccaggtgtatatgcggtgtcagtcactggtc

SEQ ID NO: 186203 - DNA, 574 bp, Homo sapiens
  Payload ID: 16668
  Gene Symbol: SUPT4H1
  Gene Name: SPT4 homolog, DSIF elongation factor subunit
  Uniprot ID: P63272
  ENST ID: ENST00000580947
  CDS Start-End: 187-540
acaaatgactgcgttctgcctgcactcgggctattgcgaggacagagagctggtgctccattggcgtgaagtctccagggccagaaggggcctttgtcgcttcctcacaaggcacaagttccccttctgcttccccgagaaaggctgtggtcgtctatctccctgttgttcttcccatcggcgaagatggccctggagacggtgccgaaggacctgcggcatctgcgggcctgtttgctgtgttcgctggtcaagactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcagtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctcca

SEQ ID NO: 186204 - DNA, 1401 bp, Homo sapiens
  Payload ID: 16668
  Gene Symbol: SUPT4H1
  Gene Name: SPT4 homolog, DSIF elongation factor subunit
  ENST ID: ENST00000581166
  CDS Start-End: 33-212
ctatctccctgttgttcttcccatcggcgaagatggccctggagacggtgccgaaggacctgcggcatctgcgggcctgtttgctgtgttcgctggtcaagactatagaccagtttgaatatgatggttgtgacaattgtgatgcatatctacaaatgaagggtaaccgagagatggtatatgactgcactagctcttcctttgatgggtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatgacacctgccttgcctccctcttccattctcttaggcacagtaatagcttatttgccctataagaaccttcccagagcagcagaggcccttctactccctcttgactgtctcagcctctgggattgcagcctttgtagtgtgcttccttgcttcctatcggagggtgctgatccagaggctcagtaaccccatcaacttggtggccctggtgtctcacacttgtatccttctgccctcgagacctggcacagcagtatcccttgaagaaatcctgaggctttgtagagtgctccttgaccatgtttaataattcttccctcccctgcttgtctattttcttctcttcacggctcttcctataccttaggccagtctcaagcactcactggagacccttgggccttgggcgaccattgagtcctagtctcccttgtttgtgcccctgtaggaggtaggtccttttctcctccggcctagtaggggaccttgggtaacatcccatttttcggccaaggtgagttgttttaggataaaaaaatttaccacaaattctcatttaaatttccacagaaatcctgttcgtatccccattttgatttccctaagttccttgttctccctctaaaaagagaatgattgcaccctgcctgtttacctcaggattgttgtgattgtagaaacgaagctatgtgaaaattatataagtattataaaggtgaaatacttttgctctcctt

SEQ ID NO: 186205 - DNA, 668 bp, Homo sapiens
  Payload ID: 16668
  Gene Symbol: SUPT4H1
  Gene Name: SPT4 homolog, DSIF elongation factor subunit
  ENST ID: ENST00000581540
  CDS Start-End: 112-438
agctttgagagtagtaggtggggaaccttaggatacacagtcaacatagggaaacaagaaattgagcaggtcgaagtattgagaaagctactttttctcttggtcttgttcatgcttatctctccttttcctttatttttctttcactcccagactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcagtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtagga

SEQ ID NO: 186206 - DNA, 3770 bp, Homo sapiens
  Payload ID: 16669
  Gene Symbol: SUPT5H
  Gene Name: SPT5 homolog, DSIF elongation factor subunit
  Uniprot ID: O00267
  ENST ID: ENST00000359191
  CDS Start-End: 248-3499
gcgtgtgcagaggtggcagttccgggcgccggggaggtgtagagaacagattcggaaactggggaggtctagcatgtggcgtaggagggggtcctcactccgcttcgcgattgccaaaacgagcctgccggaagcgccctaaggggttttcttctcccagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatacgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaa

SEQ ID NO: 186207 - DNA, 3698 bp, Homo sapiens
  Payload ID: 16669
  Gene Symbol: SUPT5H
  Gene Name: SPT5 homolog, DSIF elongation factor subunit
  Uniprot ID: O00267
  ENST ID: ENST00000402194
  CDS Start-End: 180-3431
aacgggtaggttctcgcgagaggacccgtcagccccagtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatacgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtct

SEQ ID NO: 186208 - DNA, 3710 bp, Homo sapiens
  Payload ID: 16669
  Gene Symbol: SUPT5H
  Gene Name: SPT5 homolog, DSIF elongation factor subunit
  Uniprot ID: O00267
  ENST ID: ENST00000432763
  CDS Start-End: 180-3443
aacgggtaggttctcgcgagaggacccgtcagccccagtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatacgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtct

SEQ ID NO: 186209 - DNA, 3742 bp, Homo sapiens
  Payload ID: 16669
  Gene Symbol: SUPT5H
  Gene Name: SPT5 homolog, DSIF elongation factor subunit
  Uniprot ID: O00267
  ENST ID: ENST00000598725
  CDS Start-End: 208-3471
agagaacagattcggaaactggggaggtctagcatgtggcgtaggagggggtcctcactccgcttcgcgattgccaaaacgagcctgccggaagcgccctaaggggttttcttctcccagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatacgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaa

SEQ ID NO: 186210 - DNA, 493 bp, Homo sapiens
  Payload ID: 16669
  Gene Symbol: SUPT5H
  Gene Name: SPT5 homolog, DSIF elongation factor subunit
  ENST ID: ENST00000593727
  CDS Start-End: 1-493
gaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacggtggactacgtggagcccagccagaacaccatctccctgaagatgatcccacgcatcgactacgatcgcatcaaggcccgcatgagcttgaaagactggtttgccaaaaggaagaagtttaagcggcctccacaga

SEQ ID NO: 186211 - DNA, 3902 bp, Homo sapiens
  Payload ID: 16669
  Gene Symbol: SUPT5H
  Gene Name: SPT5 homolog, DSIF elongation factor subunit
  Uniprot ID: O00267
  ENST ID: ENST00000599117
  CDS Start-End: 368-3631
aagccttttcttccctctaggccagaggaccccacctggagccctagtagccaaggggaagagttaagaaggaggaaagtaagatgtcggccccgcactccgcccaggccagccctgcctctctcaagatggcgacctggaagtgcgtcgcccgtgccagccccggaaatctcgtgttaggcgaggtcaacgggtaggttctcgcgagaggacccgtcagccccagtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatacgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaa

SEQ ID NO: 186212 - DNA, 364 bp, Homo sapiens
  Payload ID: 16669
  Gene Symbol: SUPT5H
  Gene Name: SPT5 homolog, DSIF elongation factor subunit
  ENST ID: ENST00000594729
  CDS Start-End: 58-364
gtgcgaacagcagctggtaccgaaggcggaggtggagcccgagagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatacgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaag

SEQ ID NO: 186213 - DNA, 558 bp, Homo sapiens
  Payload ID: 16669
  Gene Symbol: SUPT5H
  Gene Name: SPT5 homolog, DSIF elongation factor subunit
  ENST ID: ENST00000594990
  CDS Start-End: 397-558
gagtgtcgtgtgcggactgaagccctctgaagataccagcgagtggggagcagagccagcagacggggaaaacaaaaatgatgacaccctctacaccccagatgatctctcaatgtcggccccgcactccgcccaggccagccctgcctctctcaagatggcgacctggaagtgcgtcgcccgtgccagccccggaaatctcgtgttaggcgaggtcaacgggtaggttctcgcgagaggacccgtcagccccagtcaggcgtcgtgcgaacagcagctggtaccgaaggcggaggtggagcccgagagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatac

SEQ ID NO: 186214 - DNA, 396 bp, Homo sapiens
  Payload ID: 16669
  Gene Symbol: SUPT5H
  Gene Name: SPT5 homolog, DSIF elongation factor subunit
  ENST ID: ENST00000601515
  CDS Start-End: 90-396
ctcgcgagaggacccgtcagccccagtcaggcgtcgtgcgaacagcagctggtaccgaaggcggaggtggagcccgagagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatacgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaag

SEQ ID NO: 186215 - DNA, 6523 bp, Homo sapiens
  Payload ID: 16670
  Gene Symbol: SUPT6H
  Gene Name: SPT6 homolog, histone chaperone
  Uniprot ID: Q7KZ85
  ENST ID: ENST00000314616
  CDS Start-End: 284-5464
gagccgcttcggttacctttcgcacccacgagacgaaagcttccgagagcgggagagagaacaagaaatggcccgcccactcccggtgacagggagccggaaatgacgtagcacgttgacgcagcagcggcggcggtggcggcggaggggccgtgcggtgggtccgtactatcttttcccagtctcggttcgacgactccattttcctcggtgggggcttagcgcactggaggagcggcgggcttcagacagttatcttcaggcagagtgagaagctgcagcaatgtctgattttgtggaaagcgaggctgaggagtcagaggaagaatacaatgatgaaggcgaggtggtaccccgagtcaccaagaaatttgtggaagaggaggatgatgatgaggaggaggaggaggagaacctagatgatcaggatgagcaaggcaacttgaaaggctttatcaatgacgatgatgatgaagatgaaggggaggaggatgagggcagtgactctggtgattcagaagatgatgttggccacaagaagagaaaacgcacctcttttgatgaccgcctggaggatgatgattttgacctcattgaggagaatttgggtgtcaaagtcaaaagaggacaaaagtaccggcgtgtcaaaaaaatgtcagatgacgaggacgatgacgaggaggaatatggcaaggaggaacatgaaaaagaagctattgcggaagaaatcttccaggatggggaaggggaagaagggcaggaggccatggaggcccccatggctcctccagaggaggaggaagaagatgatgaggagtcagatattgacgacttcattgtggatgatgatggacagcctctgaaaaaacctaagtggcggaaaaagcttcctggatacacagacgcggccctgcaagaagcccaggaaatcttcggtgtggactttgactatgatgaatttgagaaatacaatgagtatgatgaagaactggaggaagagtatgagtatgaggatgatgaggctgagggtgaaatccgagtgcgccccaagaagaccaccaagaagcgtgtgagccgtaggagcatctttgaaatgtatgagcccagtgagctagaaagcagccacctcacagatcaggacaatgaaatccgagccactgacctgcctgagaggttccagctccgctccatcccagtcaagggggctgaagatgatgaactagaagaagaagctgactggatctacaggaatgcttttgccacaccaaccatttctctccaggaaagctgtgattacctagaccgagggcagccagccagcagcttcagtcggaaagggcccagcacaattcagaagatcaaagaggccctgggcttcatgcgaaatcagcattttgaggtgccttttattgccttctatcgaaaggagtatgtggagcctgagttgcacatcaatgacctatggagagtctggcagtgggatgaaaagtggacccagctgcggatccgtaaagagaacctaacacggctgtttgagaagatgcaggcttatcagtatgaacagatctctgctgaccctgacaaacctcttgctgatggcatccgggctctggacaccactgacatggagaggctcaaggatgtccaatcaatggatgagctgaaagatgtctacaaccattttcttctttattatggccgagacatccctaagatgcagaacgccgccaaagctagccgcaagaagctgaagcgtgtcagggaagagggagatgaagaaggtgaaggtgacgaggcagaagatgaggagcagagggggcctgagctcaagcaagcctctcgccgagacatgtacaccatctgccagagtgctgggctagatggcctggccaaaaagtttgggcttactcccgagcagtttggggagaacctgcgggatagctaccagcggcacgagacagagcagtttcccgcggagcccttggagctggccaaggattacgtttgcagccagttccctactccagaagctgtgctagaaggcgcccgctacatggtagccctgcagattgcccgtgagccccttgtccggcaggtgctgaggcaaaccttccaagagagagccaagttaaatataacccccaccaagaaaggtagaaaggatgtggatgaggcccactatgcctattccttcaagtatttaaagaacaagcctgttaaggaactgagagatgaccagtttctcaagatatgcctggctgaagacgaagggctcctcaccactgacatcagcatagatttgaagggagtggaaggctatggcaacgaccagacatattttgaggagataaaacagttttactaccgagatgagttcagccaccaggtgcaggagtggaaccggcagcgcaccatggccatcgaacgggctttacagcagttcctctatgtgcagatggccaaagaactcaagaacaagctgctggctgaagccaaggaatatgtcataaaggcctgtagtcgaaagctctacaattggttgagagtggcaccctaccgaccagatcagcaggtggaagaagatgacgactttatggacgagaaccaagggaagggcattcgagtcctcggcattgctttctcctctgccagagatcaccctgtgttctgcgccctggtcaatggtgaaggagaagtgacagacttccttcgactgccccattttaccaaacggcgaactgcatggagagaggaagagcgggaaaagaaggctcaagacattgaaacgctaaagaaatttctcctgaataagaagcctcatgtagtgacagttgcaggagagaacagggacgcccagatgttgattgaagatgtgaagcgcattgtacatgagctggaccagggccagcagctgtcatctattggggtagagctggttgacaacgagttggccattctctatatgaacagcaagaagtcagaggcagagttccgggattatcctccagtgctgagacaggccgtctccctggcccggcgcatccaggaccctctgattgaatttgcccaggtgtgcagttccgatgaagacatcctgtgtctcaagtttcaccccttgcaggagcatgtggtgaaagaggagctgctcaacgccttgtactgtgaatttatcaaccgagtcaatgaggtcggggtcgatgtcaaccgtgccattgcccacccttacagccaggccttgatccagtatgtttgtggcctgggacctcggaaagggacccacctcctgaagatcctgaagcagaacaacacccggctcgagagccggacccagctggtcaccatgtgccacatgggtcccaaagtcttcatgaattgtgctggcttcctcaagatcgacacggcctccctgggggacagcactgactcatatattgaagtccttgatggttcccgtgtccaccctgagacttatgagtgggctaggaagatggcagtggatgccctggaatacgatgaatcagccgaggatgccaatcctgcaggagcccttgaagaaatcttggaaaacccagagcgactgaaagacctggaccttgatgcctttgcagaagagctggagaggcagggctatggtgacaaacacatcacactctatgacatccgggcagagctgagctgtcgatataaggacctccggacagcctaccgctctcccaacacagaggagatcttcaatatgttaaccaaagaaacaccagagaccttctacattggaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgtggaaccactttgacagcggttcgtgcccaggccaggccatcggtgtcaaaacacggctagacaatggtgtcaccggcttcatccccaccaaattcctcagtgacaaagtggtaaagcggccagaagaacgagtgaaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgagctcttgccaaagcctctctctccaactctccagctctttgaggggtggctttcaaagcagtgtttggagctccaaggactcccctgactccctcttctgatccatcagaggcaaagattcatagactagaggcagcttctacatcagactgcctggggcacatccctgctctacttcccagccgggtgaccctgtgccagttcctgctgcctttcagctggctttcttacctgtaacatggagatagtgatacctgcctcatcagctgctgtgaggaccaaggcagcgtgtgcaagctccttggcccaacgcctggtacgtcgcaaatgttacccggtattattacacccactcactcacccacagcacagctgccccatccgcccatgcctgctggtcttctctggcaccctggagaaaggccacaagtaaatctggatttctcaacttga

SEQ ID NO: 186216 - DNA, 5569 bp, Homo sapiens
  Payload ID: 16670
  Gene Symbol: SUPT6H
  Gene Name: SPT6 homolog, histone chaperone
  Uniprot ID: Q7KZ85
  ENST ID: ENST00000347486
  CDS Start-End: 279-5459
gtagcacgttgacgcagcagcggcggcggtggcggcggaggggccgtgcggtgggtccgtactatcttttcccagtctcggttcgacgactccattttcctcggtgggggcttagcgcactggaggagcggcgggcttcagacaggctggaatgcagtggcgcaatctgcaacctccaccttccggattcaagagattctcctgcctcagcctcctgagtagcctggcttttgccttctttttgaaattatcttcaggcagagtgagaagctgcagcaatgtctgattttgtggaaagcgaggctgaggagtcagaggaagaatacaatgatgaaggcgaggtggtaccccgagtcaccaagaaatttgtggaagaggaggatgatgatgaggaggaggaggaggagaacctagatgatcaggatgagcaaggcaacttgaaaggctttatcaatgacgatgatgatgaagatgaaggggaggaggatgagggcagtgactctggtgattcagaagatgatgttggccacaagaagagaaaacgcacctcttttgatgaccgcctggaggatgatgattttgacctcattgaggagaatttgggtgtcaaagtcaaaagaggacaaaagtaccggcgtgtcaaaaaaatgtcagatgacgaggacgatgacgaggaggaatatggcaaggaggaacatgaaaaagaagctattgcggaagaaatcttccaggatggggaaggggaagaagggcaggaggccatggaggcccccatggctcctccagaggaggaggaagaagatgatgaggagtcagatattgacgacttcattgtggatgatgatggacagcctctgaaaaaacctaagtggcggaaaaagcttcctggatacacagacgcggccctgcaagaagcccaggaaatcttcggtgtggactttgactatgatgaatttgagaaatacaatgagtatgatgaagaactggaggaagagtatgagtatgaggatgatgaggctgagggtgaaatccgagtgcgccccaagaagaccaccaagaagcgtgtgagccgtaggagcatctttgaaatgtatgagcccagtgagctagaaagcagccacctcacagatcaggacaatgaaatccgagccactgacctgcctgagaggttccagctccgctccatcccagtcaagggggctgaagatgatgaactagaagaagaagctgactggatctacaggaatgcttttgccacaccaaccatttctctccaggaaagctgtgattacctagaccgagggcagccagccagcagcttcagtcggaaagggcccagcacaattcagaagatcaaagaggccctgggcttcatgcgaaatcagcattttgaggtgccttttattgccttctatcgaaaggagtatgtggagcctgagttgcacatcaatgacctatggagagtctggcagtgggatgaaaagtggacccagctgcggatccgtaaagagaacctaacacggctgtttgagaagatgcaggcttatcagtatgaacagatctctgctgaccctgacaaacctcttgctgatggcatccgggctctggacaccactgacatggagaggctcaaggatgtccaatcaatggatgagctgaaagatgtctacaaccattttcttctttattatggccgagacatccctaagatgcagaacgccgccaaagctagccgcaagaagctgaagcgtgtcagggaagagggagatgaagaaggtgaaggtgacgaggcagaagatgaggagcagagggggcctgagctcaagcaagcctctcgccgagacatgtacaccatctgccagagtgctgggctagatggcctggccaaaaagtttgggcttactcccgagcagtttggggagaacctgcgggatagctaccagcggcacgagacagagcagtttcccgcggagcccttggagctggccaaggattacgtttgcagccagttccctactccagaagctgtgctagaaggcgcccgctacatggtagccctgcagattgcccgtgagccccttgtccggcaggtgctgaggcaaaccttccaagagagagccaagttaaatataacccccaccaagaaaggtagaaaggatgtggatgaggcccactatgcctattccttcaagtatttaaagaacaagcctgttaaggaactgagagatgaccagtttctcaagatatgcctggctgaagacgaagggctcctcaccactgacatcagcatagatttgaagggagtggaaggctatggcaacgaccagacatattttgaggagataaaacagttttactaccgagatgagttcagccaccaggtgcaggagtggaaccggcagcgcaccatggccatcgaacgggctttacagcagttcctctatgtgcagatggccaaagaactcaagaacaagctgctggctgaagccaaggaatatgtcataaaggcctgtagtcgaaagctctacaattggttgagagtggcaccctaccgaccagatcagcaggtggaagaagatgacgactttatggacgagaaccaagggaagggcattcgagtcctcggcattgctttctcctctgccagagatcaccctgtgttctgcgccctggtcaatggtgaaggagaagtgacagacttccttcgactgccccattttaccaaacggcgaactgcatggagagaggaagagcgggaaaagaaggctcaagacattgaaacgctaaagaaatttctcctgaataagaagcctcatgtagtgacagttgcaggagagaacagggacgcccagatgttgattgaagatgtgaagcgcattgtacatgagctggaccagggccagcagctgtcatctattggggtagagctggttgacaacgagttggccattctctatatgaacagcaagaagtcagaggcagagttccgggattatcctccagtgctgagacaggccgtctccctggcccggcgcatccaggaccctctgattgaatttgcccaggtgtgcagttccgatgaagacatcctgtgtctcaagtttcaccccttgcaggagcatgtggtgaaagaggagctgctcaacgccttgtactgtgaatttatcaaccgagtcaatgaggtcggggtcgatgtcaaccgtgccattgcccacccttacagccaggccttgatccagtatgtttgtggcctgggacctcggaaagggacccacctcctgaagatcctgaagcagaacaacacccggctcgagagccggacccagctggtcaccatgtgccacatgggtcccaaagtcttcatgaattgtgctggcttcctcaagatcgacacggcctccctgggggacagcactgactcatatattgaagtccttgatggttcccgtgtccaccctgagacttatgagtgggctaggaagatggcagtggatgccctggaatacgatgaatcagccgaggatgccaatcctgcaggagcccttgaagaaatcttggaaaacccagagcgactgaaagacctggaccttgatgcctttgcagaagagctggagaggcagggctatggtgacaaacacatcacactctatgacatccgggcagagctgagctgtcgatataaggacctccggacagcctaccgctctcccaacacagaggagatcttcaatatgttaaccaaagaaacaccagagaccttctacattggaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgtggaaccactttgacagcggttcgtgcccaggccaggccatcggtgtcaaaacacggctagacaatggtgtcaccggcttcatccccaccaaattcctcagtgacaaagtggtaaagcggccagaagaacgagtgaaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgaga

SEQ ID NO: 186217 - DNA, 505 bp, Homo sapiens
  Payload ID: 16670
  Gene Symbol: SUPT6H
  Gene Name: SPT6 homolog, histone chaperone
  ENST ID: ENST00000577713
  CDS Start-End: 356-505
gaacaattctcttcaaatccccagctcttagcagagtatatgtacattgtaggcattcagttaggtttgtggaaagaatggcatctgaaacctcaaccgaaaattgaacattccccctccctcctataccttcagttttgttttcttgagtttagttaatctcaagttcattggttatagtattgattgagctccgtaagggcaattttgaggagaattagagccacagaacttaaggcaccttcaggtagccattagccacccttctcttctctcccctcccactgccatctttaactgggaagatggcagcaatatgaaaacttatcttcaggcagagtgagaagctgcagcaatgtctgattttgtggaaagcgaggctgaggagtcagaggaagaatacaatgatgaaggcgaggtggtaccccgagtcaccaagaaatttgtggaagaggaggatgatgatgaggaggaggaggaggagaacctagatgatcaggatgag

SEQ ID NO: 186218 - DNA, 483 bp, Homo sapiens
  Payload ID: 16670
  Gene Symbol: SUPT6H
  Gene Name: SPT6 homolog, histone chaperone
  ENST ID: ENST00000584312
  CDS Start-End: 1-162
atgtctgattttgtggaaagcgaggctgaggagtcagaggaagaatacaatgatgaaggcgaggtggtaccccgagtcaccaagaaatttgtggaagaggaggatgatggtgaggaggccccagcctcaagcttctccccactattgctaagctttggatagttggattcttgctgatgaaaagctcaggctcagcacagaagttatcacacatgagatgaggaggaggaggaggagaacctagatgatcaggatgagcaaggcaacttgaaaggctttatcaatgacgatgatgatgaagatgaaggggaggaggatgagggcagtgactctggtgattcagaagatgatgttggccacaagaagagaaaacgcacctcttttgatgaccgcctggaggatgatgattttgacctcattgaggagaatttgggtgtcaaagtcaaaagaggacaaaagtaccggcgtgtcaaaaaaatgtca

SEQ ID NO: 186219 - DNA, 4488 bp, Homo sapiens
  Payload ID: 16671
  Gene Symbol: SUPT7L
  Gene Name: SPT7-like STAGA complex gamma subunit
  Uniprot ID: O94864
  ENST ID: ENST00000337768
  CDS Start-End: 571-1815
cggcgatggtgaagttgctccttcacgacctggagcgttgcgaagtggtgctaacatgagaaggtcataatatgagaaaaacaaaacggttatcgggatgctgtgcagaacggggacatatttagaggttacaacgggatcgtaatgacttcctgttgcatagcttgattgagaagaagcgcttccggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcgggcaaggatctcacattatcagtctttgaccgacacagaatgcctggcatttgataaatgtttgttgaacttgaagagacatatggacaatgaatctgcaaagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcgtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctcatatcagatgtcagttttcatttaacttgattcatttttggctcaggtcattgggaacccattactaatacctaacaggaaatagctaaacacaacacaccttatctattagtcaccttcttaaaactgtttttgctacttttgaagtgtcttatttataagatcagaggtctgacaccttttttgcttagacagctctctatctcatccatttattttcttctctagacttactccatctctcctcatccttttgcctttgttatttctgctcggactcacatactttcaccatatacatattttcaattgtttctttccttttctcctttgtgagcaaagcaaacaagtactgtccaaggacagccttgtgcatatttcatttgttgcatttgcttggtcatcagaggacagcagtccattaagcacactttgctgcttctactgtaaaggcagcctttaaaacatagcaatatgcacctttcaactttacatcatgtcctgaacaacatcactgtggttactcatccatcagactatctgtatatataagtactgaatcagtatttattaagtaaatgatgtagcactgtagtgattaggaatcattagcaaatgtgttgcttcatgccttggtgatggatgccagcatgttaaactgctgaagtttgattttctgatgcaaaatatatcttgtaaaatttagaccactcctttaatgcagaccaaaataaggcacagctttaattcattattgaatgccttaaatgtcccaggtattgagaataaatgaatatgatacaaatgaggttatagtttaacatataattttaaatttgccaattgtaactctttagcacatttctctaaaccctttctgtcacagtcttttttttaatttatttatttatttatttatttttgagatggagtcttgctctgtcacccaggctggagtgcaatggtgcaatttcgactcactgcaacctctgcctcccaggttcaagcgattctcctgcctcagccacctgagtagctgggattacacgcacatgccaccacacccagctaatttttgcatttttagtagagatgaggtttcaccgtgttggccaggctggtctcaaaactcctgacctcaagtgatctgcccgcctcgggctcccaaagtgctgggattacaggcgtgagccactgcacctggcctctgttgcagtcttatcttcattttcctttgtttataatgaaagtggcgattaggcagttagtttccataaagtggccgtatgggaatttagttcattcatccagcaaacattgagtaccaattatttgctaggtcctgtgcaaggaatacaaaaatgattaagacttcttccttacccttttggagcttgaagcataaggaagacaagttattctgtaaggaagataaagcattcaaaagtactacagagaaaaaccaagtatgcttgagttttgcgaatgttctcctcttaaagaatagcttcaaattttgagaccagtggttcccactaagtatagaacattaaaattaatactttataataaaacacttttattgctgcagaatgttaaactgcataacaggcaccagatggtcaagacgagggaaatatgagaaggcaaatgatgtgaggattagtatcttgagattcacctggtctggaattatgtcataggctactatgcatcagaatcacatggagggctttctaaaacagactgctcagcccacccccagggtttctgagttcataggttataagaggtaagttgaacaattccccagatgatgctgatgctcctggtccacaatgtgagaaccactaagttggagtactgactcatagagataaaattctttgaaagaaatgtactgttttaagatactgtaaaatgtggaggcagggcaaacgtttataagggctgttatgtatgaaatgtgcctctgacccaaatccacggactttgcgaaaatcaccaaggagactttgcattaagttcagagtacaatacaaactgggcctagctctgtatttagtcagtatgtgcacgtgggaaactttagtaaaatatcacctccttattgagacaagtttggacatctggccttaagcctctgttgaacaggagaagtgaagctgtttgcaattatataattttctaatttgaaatcatgacaagcagtcttagaacaaagttaaaattaaaaagtctttatccaagtcaccaatg

SEQ ID NO: 186220 - DNA, 2280 bp, Homo sapiens
  Payload ID: 16671
  Gene Symbol: SUPT7L
  Gene Name: SPT7-like STAGA complex gamma subunit
  Uniprot ID: O94864
  ENST ID: ENST00000405491
  CDS Start-End: 620-1858
gagaagaagcgcttccggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcgggcaaggatctcacattatcagtctttgaccgacacagaatgcctggcatttgataaatgtttgttgaacttgaagagacatatggacaatgaatctgcaaagggagaacacctttggtcctacagttttgctgacactgacatttttctaagtggtcacaaatagcctactttttacataaataactggctagacctcgtatttttcactacagaagcctataatctaaagttgccaggatttaaacacattacttttaggttattgtctacatttatcctgagacctcttctcttcttattccaaaatgttgagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcgtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctcatatcaga

SEQ ID NO: 186221 - DNA, 4114 bp, Homo sapiens
  Payload ID: 16671
  Gene Symbol: SUPT7L
  Gene Name: SPT7-like STAGA complex gamma subunit
  Uniprot ID: O94864
  ENST ID: ENST00000404798
  CDS Start-End: 602-1441
actctcccaagctcccagtggcgtctgtaggcggcgatggtgaagttgctccttcacgacctggagcgttgcgaagtggtgctaacatgagaaggtcataatatgagaaaaacaaaacggttatcgggatgctgtgcagaacggggacatatttagaggttacaacgggatcgtaatgacttcctgttgcatagcttgattgagaagaagcgcttccggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcgggcaaggatctcacattatcagtctttgaccgacacagaatgcctggcatttgataaatgtttgttgaacttgaagagacatatggacaatgaatctgcaaagtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctcatatcagatgtcagttttcatttaacttgattcatttttggctcaggtcattgggaacccattactaatacctaacaggaaatagctaaacacaacacaccttatctattagtcaccttcttaaaactgtttttgctacttttgaagtgtcttatttataagatcagaggtctgacaccttttttgcttagacagctctctatctcatccatttattttcttctctagacttactccatctctcctcatccttttgcctttgttatttctgctcggactcacatactttcaccatatacatattttcaattgtttctttccttttctcctttgtgagcaaagcaaacaagtactgtccaaggacagccttgtgcatatttcatttgttgcatttgcttggtcatcagaggacagcagtccattaagcacactttgctgcttctactgtaaaggcagcctttaaaacatagcaatatgcacctttcaactttacatcatgtcctgaacaacatcactgtggttactcatccatcagactatctgtatatataagtactgaatcagtatttattaagtaaatgatgtagcactgtagtgattaggaatcattagcaaatgtgttgcttcatgccttggtgatggatgccagcatgttaaactgctgaagtttgattttctgatgcaaaatatatcttgtaaaatttagaccactcctttaatgcagaccaaaataaggcacagctttaattcattattgaatgccttaaatgtcccaggtattgagaataaatgaatatgatacaaatgaggttatagtttaacatataattttaaatttgccaattgtaactctttagcacatttctctaaaccctttctgtcacagtcttttttttaatttatttatttatttatttatttttgagatggagtcttgctctgtcacccaggctggagtgcaatggtgcaatttcgactcactgcaacctctgcctcccaggttcaagcgattctcctgcctcagccacctgagtagctgggattacacgcacatgccaccacacccagctaatttttgcatttttagtagagatgaggtttcaccgtgttggccaggctggtctcaaaactcctgacctcaagtgatctgcccgcctcgggctcccaaagtgctgggattacaggcgtgagccactgcacctggcctctgttgcagtcttatcttcattttcctttgtttataatgaaagtggcgattaggcagttagtttccataaagtggccgtatgggaatttagttcattcatccagcaaacattgagtaccaattatttgctaggtcctgtgcaaggaatacaaaaatgattaagacttcttccttacccttttggagcttgaagcataaggaagacaagttattctgtaaggaagataaagcattcaaaagtactacagagaaaaaccaagtatgcttgagttttgcgaatgttctcctcttaaagaatagcttcaaattttgagaccagtggttcccactaagtatagaacattaaaattaatactttataataaaacacttttattgctgcagaatgttaaactgcataacaggcaccagatggtcaagacgagggaaatatgagaaggcaaatgatgtgaggattagtatcttgagattcacctggtctggaattatgtcataggctactatgcatcagaatcacatggagggctttctaaaacagactgctcagcccacccccagggtttctgagttcataggttataagaggtaagttgaacaattccccagatgatgctgatgctcctggtccacaatgtgagaaccactaagttggagtactgactcatagagataaaattctttgaaagaaatgtactgttttaagatactgtaaaatgtggaggcagggcaaacgtttataagggctgttatgtatgaaatgtgcctctgacccaaatccacggactttgcgaaaatcaccaaggagactttgcattaagttcagagtacaatacaaactgggcctagctctgtatttagtcagtatgtgcacgtgggaaactttagtaaaatatcacctccttattgagacaagtttggacatctggccttaagcctctgttgaacaggagaagtgaagctgtttgcaattatataattttctaatttgaaatcatgacaagcagtcttagaacaaagttaaaattaaaaagtctttatccaagtcaccaatg

SEQ ID NO: 186222 - DNA, 2869 bp, Homo sapiens
  Payload ID: 16671
  Gene Symbol: SUPT7L
  Gene Name: SPT7-like STAGA complex gamma subunit
  Uniprot ID: O94864
  ENST ID: ENST00000406540
  CDS Start-End: 1198-2436
tgagaagaagcgcttccggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcgggcaaggatctcacattatcagtctttgaccgacacagaatgcctggcatttgataaatgtttgttgaacttgaagagacatatggacaatgaatctgcaaaggtgagttgaaaccagattgtgaattttgttgaatggtaagccaaggaattctgactttttccaataggcaatgggaagccatttgatttaagttttaaaaagagtaagtctagcagcagtgtagagaatagatgacatacaaagagagattggaggaagggataccagttagaaggcagcagaaatctctcacgttctatatgtcaaaagttgaaagcataatgccatttagattaatggttcataaatttttccaccaggatcatgcctaagacacacagagtaagaaccacttcttattatctttaaccctactagtttttctcctattgatccagcacagatgtatcaagataccttatcatgccttgcttattgttcaggattgagcgtgatggtagttctggtaatgagttagtgagtgagatgggaaatagggatactagagctccagatgctgttgtagctattggtccactaatgacccaaattctaccctgtggttcagtgtagtaggaattgtcatagtatgacaataaccagcatctaacagttacatttctcttaatttatttagggagaacacctttggtcctacagttttgctgacactgacatttttctaagtggtcacaaatagcctactttttacataaataactggctagacctcgtatttttcactacagaagcctataatctaaagttgccaggatttaaacacattacttttaggttattgtctacatttatcctgagacctcttctcttcttattccaaaatgttgagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcgtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctcatatcagatgtcagttttc

SEQ ID NO: 186223 - DNA, 2664 bp, Homo sapiens
  Payload ID: 16671
  Gene Symbol: SUPT7L
  Gene Name: SPT7-like STAGA complex gamma subunit
  Uniprot ID: O94864
  ENST ID: ENST00000464789
  CDS Start-End: 1011-2249
gagaagaagcgcttccggcggtcttagatcactaatcaacaaaccagctttcggggtctgacgcgatccttgcctcaggcctctcgaggtccagacagccgcccagcccgctctgcgacgcagcaggcaaggatctcacattatcagtctttgaccgacacagaatgcctggcatttgataaatgtttgttgaacttgaagagacatatggacaatgaatctgcaaaggtgagttgaaaccagattgtgaattttgttgaatggtaagccaaggaattctgactttttccaataggcaatgggaagccatttgatttaagttttaaaaagagtaagtctagcagcagtgtagagaatagatgacatacaaagagagattggaggaagggataccagttagaaggcagcagaaatctctcacgttctatatgtcaaaagttgaaagcataatgccatttagattaatggttcataaatttttccaccaggatcatgcctaagacacacagagtaagaaccacttcttattatctttaaccctactagtttttctcctattgatccagcacagatgtatcaagataccttatcatgccttgcttattgttcaggattgagcgtgatggtagttctggtaatgagttagtgagtgagatgggaaatagggatactagagctccagatgctgttgtagctattggtccactaatgacccaaattctaccctgtggttcagtgtagtaggaattgtcatagtatgacaataaccagcatctaacagttacatttctcttaatttatttagggagaacacctttggtcctacagttttgctgacactgacatttttctaagtggtcacaaatagcctactttttacataaataactggctagacctcgtatttttcactacagaagcctataatctaaagttgccaggatttaaacacattacttttaggttattgtctacatttatcctgagacctcttctcttcttattccaaaatgttgagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcgtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctca

SEQ ID NO: 186224 - DNA, 1437 bp, Homo sapiens
  Payload ID: 16672
  Gene Symbol: SPTY2D1-AS1
  Gene Name: SPTY2D1 antisense RNA 1
  ENST ID: ENST00000501599
  CDS Start-End: 126-305
agactcgaacagacatgcgagacctctaccaactgaaggtttcgtgagcgcactcctttgccaagatcttggtgaatagtctttcactgtgcaattttatcttagaaattgttttacgtttgatcatgattgtgcttggctggatgttttttgttggacttgtgtgttacatgggcacgtttccagagttgatgcctccaactctgaagtggcaggagaggtggcctgttcaggagagcaaaacacaactgaggaggcgggctttaggtgaagatctgctgcagaaccatgtggaagggatataaatatcccccaggagggactccagtggaagtaagcaaggatgatcctggtgaagtaatgcagctgtgaagctcacctgaccagctgtacagttcctgttgttggtttcacataaaccacctaaattaatgagtaagaatgctcagcatccaatccatgaatacagaatttattctactttgtacttcaaagtcacaggatgacatccatatgatagttataaattctactctacattttcaagttctcaatccatagattaggacaagtcactttattgctggcaacattcatggaaggtccaggtttctcataaaaagactaagtttgattgggagcagggcagtgccctactcacagatcagcagaagaattacagaaatcaagagacaaccttttttttcctttcaaagtagcaaaggaacaataaaagattggctgactggtgagtggccccacattagagtgcatagctcatcaggatcaaggctggcatctgtgaacagttaacttcataagagcacaagtgggcattatatcatctgcattacagatttcaccctggaaaatatctgaaaatattttatgctcaaatgacagcctgcaaatgacagtatgcattccttctccttgagtacccaagtataaatctaaaatgataagggggcttcttcagtctgaaggcaggaaatccttgcagcagagcagctctagaatttcacaaaaataaaagcagcagctaacgcctcttcagcttcttggcccttcgacgttgcatttcttcttcttcacgtctcatttcctctaagtcctcttgcatacccagtcttaagctgccaaagaatttttaaagggtatttgtcaatatacatgagatgaccactttccttaaaaagaatgaaaattccaactgggagctcacatggattgtgctgatgctctcaaaatgcctcaaggctttaccactgaaaacaaactagcagggatatttttttaccaggggccacagactcaaattgtcgtgggaaaaagaactcacacaccacaaaaaccttactatttccattaaaataataaaatataggtttatctcaatagcttttaaaaataaacagcaagaagcatttattcatt

SEQ ID NO: 186225 - DNA, 573 bp, Homo sapiens
  Payload ID: 16672
  Gene Symbol: SPTY2D1-AS1
  Gene Name: SPTY2D1 antisense RNA 1
  ENST ID: ENST00000511927
  CDS Start-End: 141-311
atcctttggagccaaagactcgaacagacatgcgagacctctaccaactgaaggtttcgtgagcgcactcctttgccaagatcttggtgaatagtctttcactgtgcaattttatcttagaaattgttttacgtttgatcatgattgtgcttggctggatgttttttgttggacttgtgtgttacatgggcacgtttccagagttgatgcctccaactctgaagtggcaggagaggtggcctgttcaggagagcaaaacacaactgaggaggcgggctttaggtcttgctctgccacccaggctggagtgaggtgcaagcagtcttcccatctcagcttcttgggtagctgatcctcaggcacatgccaccatgcctggctaattttttttttatttttttagagacaaggtgtcactatgttgcccaggcaggtcttgaactccaggcctcaagtggtcccccagccttggcctcccagagtgctgggattgcaggcataaaccaccgtgccttgccaggaccagcatttttaacgtcccttttggcagatactgaaactggagttaacatt

SEQ ID NO: 186226 - DNA, 331 bp, Homo sapiens
  Payload ID: 16672
  Gene Symbol: SPTY2D1-AS1
  Gene Name: SPTY2D1 antisense RNA 1
  ENST ID: ENST00000542172
  CDS Start-End: 138-260
gaagctccttagtgaggagctgccatgctgggccatccaccatctggattcctacgactcagggaatagaacactgcaccttccagaagcacttgtttcttcgtgggtacaccaccagctgagaaagaagcctcatgatgattgttgtcttatggatgcttctcattgcaggaaccatgtggaagggatataaatatcccccaggagggactccagtggaagtaagcaaggatgatcctggtgaagtaatgcagctgtgaagctcacctgaccagctgtacagttcctgttgttggtttcacataaagtaattgcacattattttgtcata

SEQ ID NO: 186227 - DNA, 373 bp, Homo sapiens
  Payload ID: 16672
  Gene Symbol: SPTY2D1-AS1
  Gene Name: SPTY2D1 antisense RNA 1
  ENST ID: ENST00000634992
  CDS Start-End: 143-373
ggatcctttggagccaaagactcgaacagacatgcgagacctctaccaactgaaggtttcgtgagcgcactcctttgccaagatcttggtgaatagtctttcactgtgcaattttatcttagaaattgttttacgtttgatcatgattgtgcttggctggatgttttttgttggacttgtgtgttacatgggcacgtttccagagttgatgcctccaactctgaagtggcaggagaggtggcctgttcaggagagcaaaacacaactgaggaggcgggctttaggaaccatgtggaagggatataaatatcccccaggagggactccagtggaagtaagcaaggatgatcctggtgaagtaatgcagctgtga

SEQ ID NO: 186228 - DNA, 450 bp, Homo sapiens
  Payload ID: 16672
  Gene Symbol: SPTY2D1-AS1
  Gene Name: SPTY2D1 antisense RNA 1
  ENST ID: ENST00000635674
  CDS Start-End: 143-322
ggatcctttggagccaaagactcgaacagacatgcgagacctctaccaactgaaggtttcgtgagcgcactcctttgccaagatcttggtgaatagtctttcactgtgcaattttatcttagaaattgttttacgtttgatcatgattgtgcttggctggatgttttttgttggacttgtgtgttacatgggcacgtttccagagttgatgcctccaactctgaagtggcaggagaggtggcctgttcaggagagcaaaacacaactgaggaggcgggctttaggtgaagatctgctgcagaaccatgtggaagggatataaatatcccccaggagggactccagtggaagtaagcaaggatgatcctggtgaagtaatgcagctgtgaagctcacctgaccagctgtacagttcctgttgttggtttcacataaagtaattgcacatta
